United States Patent 7,745,391 (HUMAN THROMBOSPONDIN POLYPEPTIDE) - sequence listing, part 104

SEQ ID NO: 316469 - DNA, 2603 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316470 - DNA, 2126 bp, Homo sapiens
aatgtatgttcacaaatgagccacagccttatcagctggggttgagggaagactggtctaggtgctgctcctgaacttggtctctgagccatggcttcccatagacactcaggtccctccagctacaaggtgggcaccatggcggagaagtttgactgccactactgcagggacccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316471 - DNA, 3205 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316472 - DNA, 2216 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316473 - DNA, 1567 bp, Homo sapiens
cgatcagaggatcccgacggcttcaacgggctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316474 - DNA, 1583 bp, Homo sapiens
gcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316475 - DNA, 2221 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaatgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316476 - DNA, 1406 bp, Homo sapiens
  misc_feature (15)..(15): n is a, c, g, or t
  misc_feature (35)..(35): n is a, c, g, or t
  misc_feature (62)..(62): n is a, c, g, or t
gcctttgctgaaatnctggggactcctcatatggncaagatcctatttcaggcatgacctancttatgacagttcaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316477 - DNA, 1200 bp, Homo sapiens
ccatactccgttcaacatctcatccctccttccaacatctcatctctccttccaacatctcatctctccctccaacatctcatcgctttccaacatctcatctccttccaacatctcatctccttccaacatctcatggcaccttccaacatctcatactccttccaacatctcatcgccttccaacatctcatctccttccaacatctcatcactccttccaacatctcatccctccttccaacatctcatgaccccttccaacatctcatccctgttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316478 - DNA, 1764 bp, Homo sapiens
  misc_feature (1638)..(1638): n is a, c, g, or t
  misc_feature (1668)..(1668): n is a, c, g, or t
  misc_feature (1731)..(1731): n is a, c, g, or t
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaatcactatcctcctcctgttccatttggttatccaaatcagggaagaaaaaataaaccatatcgcccnattccagtgacatgggtacctcctcctggnatgcattgtgaccggaatcactggattaatcctcacatgtagcacctcactaacttcgttttngattgtgttggtgtcatcttgagaaaagtagaa

SEQ ID NO: 316479 - DNA, 1460 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatattagccagccgtatacggatgcatggaacccgctactgagaagccgtccatgttactaatcacgggatcc

SEQ ID NO: 316480 - DNA, 1029 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316481 - DNA, 503 bp, Homo sapiens
ctctttgtccatgtgttaatgaggactgcaaagtccttctgttgtgattcctaggacttttcctcaagaggaaatctggatttccacctaccgcttacctgaaatgcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316482 - DNA, 1038 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggag

SEQ ID NO: 316483 - DNA, 447 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtacaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaa

SEQ ID NO: 316484 - DNA, 2403 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316485 - DNA, 2354 bp, Homo sapiens
tttgagctaatacggcttgataatgagggagccagatccactgccagtgctcatgttatatgataaacagacatttggagaagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316486 - DNA, 2348 bp, Homo sapiens
cccctgctgtgaagagctgtgccctgctgcattcctcctgtagctgcacgaaagggtgtggaatcttctagaaacagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316487 - DNA, 2457 bp, Homo sapiens
cccctgctgtgaagagctgtgccctgctgcattcctcctgtagctgcacgaaaattcaggtttgacgcttcagttggattgaatcgaaagagaggtatatttggtatcaggcgtttgtggtggcatgtgaaatcattatccacgtttgataacagtttgactttttgcctgctgtaataatagtagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316488 - DNA, 2417 bp, Homo sapiens
atttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316489 - DNA, 2292 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316490 - DNA, 2290 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316491 - DNA, 2406 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcatatgctgctttatttctgtaaggatacactgacacaataaccaataatagctaatgacgtcgac

SEQ ID NO: 316492 - DNA, 1632 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgatgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgcctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316493 - DNA, 1464 bp, Homo sapiens
  misc_feature (780)..(780): n is a, c, g, or t
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccgccaccgccgcgcctcggcctcggtgcaggcagcggccgccgccngagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316494 - DNA, 1370 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctttctggtggccaccagaaagggcatatcttcgtcattatttgacttttaatctatatgtgtcataatatttaaagagtatttatggtaggcagcatgtaattgggttctgcatttttatccaatttagacagtatccggtatttatactgaaggtcttcagacaatgaacactcttaatataattattgatattgcatgagatttaagcctgtcattatgctgtttg

SEQ ID NO: 316495 - DNA, 1969 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggg

SEQ ID NO: 316496 - DNA, 661 bp, Homo sapiens
cgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggacgatcaaaacttggtctcatagcaagtcacgcagtagaagtcctcccctttacgggaagaagcttccagtcccgatgacttgttccagtactacagt

SEQ ID NO: 316497 - DNA, 780 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgca

SEQ ID NO: 316498 - DNA, 1153 bp, Homo sapiens
cgcaaagtttctgctccgggaggaggcggcggcgccgcgggctcgtcgcctgggggagcagaagcgggtgggaggtgcgggtggccttggcctcagccctggtgcgcgggggccgggggtggtgaccctcctggccgaggaggggcggcgtccagacgcccgctcgggggccgccttcccccccacgcctgcccccgggcacgcgccctgcccggtccctcgccccgcgccacttccagtccgcagagagatgccctccacgtttctgctttctctgcagcctctagattgccagatgcgactgtgcgcctcgctgggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacct

SEQ ID NO: 316499 - DNA, 517 bp, Homo sapiens
tgctctagacgtactccccagttctggtccgccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaattttttttttttttttttttttttttttttttttttttttttttttttttttttttttttttttatatttttttttttgggtggggaaagagaaaaatagaaacaagaaagaaaaaatatagataggataaaa

SEQ ID NO: 316500 - DNA, 601 bp, Homo sapiens
cttccgctttcacttctaaaagctataataatgttatagacagaagacttaaatctaactgcctgagcctctgatctcactttcaaaaatcctccttatggtaaccgtatcaggggagggtaggcataataaataggaattttggaccatgtttcttgactgttactttgaattgttgtgagcttttgcaaatcctgttttctgcattagctgtttgcatgtatttagtaggttagaggtgggaactagagatcagagaattgtttatggcagcagagttagcagtaacttgagagggcatagctaagtcaaagacctacttccccacactacatcattagcaataacaattgctgaatgttcacaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgca

SEQ ID NO: 316501 - DNA, 251 bp, Homo sapiens
gcggccgcctactactactactactgctcgaattcaagcttctaacgatgtacggggtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgca

SEQ ID NO: 316502 - DNA, 640 bp, Homo sapiens
  misc_feature (18)..(18): n is a, c, g, or t
  misc_feature (20)..(20): n is a, c, g, or t
tagtcaggctcggccctntngatcttaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataaggatcccctaaggggatccttatttaaaatacagtgttagcatagatccccttttcaggaaggacccaaatgtcagtgcatagttagataaaacggtacaatgttttactgaaagcatacttttttggaaaatagattcatgaagcctttagtgctgcttctgtcagtcccaccttacaaactttaacattttctaagtgccccgaccgtgtaccaagacacatctaatggagattgtaccggttgtttttttgtttgaacctcttgaaagagttcaatcttaacgttttctcattttaaaatttaaaatcttgtttaaccaaagcttgtataagatactgttttcatttcattacagacttgtttataaaagttcattttttataagga

SEQ ID NO: 316503 - DNA, 4217 bp, Homo sapiens
cgcagactcgcgctccggtgtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316504 - DNA, 4207 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaacccccttttgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316505 - DNA, 4207 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattggtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316506 - DNA, 4314 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaaatttaggtacctaaatggctgtaactagcgacaacagtcagggatcctctaga

SEQ ID NO: 316507 - DNA, 2867 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316508 - DNA, 4203 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaacccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316509 - DNA, 3566 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggtgttcaatttctacacagagactgtctcaaaagaaaaaaaaaattgtgcttcaggccctgtgtagaaaaatgggaaattatggaaaagcagaggaaacaactgggtattaagcagtatagtgtagaaattgaa

SEQ ID NO: 316510 - DNA, 4236 bp, Homo sapiens
cagaaaagaaaacttgaagtgagcagatgttgtcacttccttgtaatcctttgttaaaatagcataaggagttttctttattctatttactttcattaaatgaccgtgctacaggtttcaaaggattttaagattgatttttgaaagatcacaatattaaaagtataactggaaaacctatgttgaaatcaaccaaacatgtcgtggactgaatgataaccttttctttcttcatataggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316511 - DNA, 4144 bp, Homo sapiens
tggccatcactgtcagtgtatgttggtttagcgttgtctgcattgttctagagtgaaacaggtgtcaggctgtcactgttcacacaaatttttaataagaaacatttaccaagggagcatctttggactcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316512 - DNA, 2977 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcacagcaaggctgtgttgccaagatacgaaccttgtatattcagcgacctcgccctcgcacccaag

SEQ ID NO: 316513 - DNA, 3884 bp, Homo sapiens
ataggtgaaatggtatgactataaaaggatagtacttttgtctcctggagtgacatgatgcctttctagagaaagacatcatagtcactccggagtgacgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316514 - DNA, 4082 bp, Homo sapiens
cttccgctttcacttctaaaagctataataatgttatagacagaagacttaaatctaactgcctgagcctctgatctcactttcaaaaatcctccttatggtaaccgtatcaggggagggtaggcataataaataggaattttggaccatgtttcttgactgttactttgaattgttgtgagcttttgcaaatcctgttttctgcattagctgtttgcatgtatttagtaggttagaggtgggaactagagatcagagaattgtttatggcagcagagttagcagtaacttgagagggcatagctaagtcaaagacctacttccccacactacatcattagcaataacaattgctgaatgttcacaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316515 - DNA, 3315 bp, Homo sapiens
cgatctagaggatgcccgccaatatgtatattttatttaatatatatataaaagattgccatatggtatgcaaacagtcccatgtctctggtattttaataaggctaggggatccttattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316516 - DNA, 1722 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaattttttttttttttttttttttttttttttttttttttttttttttttttttttttttttttttatatttttttttttgggtggggaaagagaaaaatagaaacaagaaagaaaaaatatagataggataaaa

SEQ ID NO: 316517 - DNA, 2007 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaataagtttaaaacaaaaaaagaaaacaaaaaaaaaaaaaaaaaaaaaaaaaaaaaaaaaaaagggggggggggtaaaaaattctcccggggggggcccaagttagcgggtaaccgagtttttgtggacaaggggggccccaatatagaggaggaggcgaatattatataagacctgaagccaggggcgccagctctattaaacaacgccgggacggcgggaacacacgtgtctagtggggactccttgtggagaaggaccccactaccctgggggcggcgaacattttgtggggacaactctcctaaggagaatttaaagggctggaggaactatcacagttaacgtgatgtgggtgtttaaaccagaggtattatcgtgagatgagaattgctacgggcagtgattcaaaattttcgg

SEQ ID NO: 316518 - DNA, 1982 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaaaaaaaaaaaaaaaaaaaaaaaaaaaaaaaaaaaaagggggggggggtaaaaaattctcccggggggggcccaagttagcgggtaaccgagtttttgtggacaaggggggccccaatatagaggaggaggcgaatattatataagacctgaagccaggggcgccagctctattaaacaacgccgggacggcgggaacacacgtgtctagtggggactccttgtggagaaggaccccactaccctgggggcggcgaacattttgtggggacaactctcctaaggagaatttaaagggctggaggaactatcacagttaacgtgatgtgggtgtttaaaccagaggtattatcgtgagatgagaattgctacgggcagtgattcaaaattttcgg

SEQ ID NO: 316519 - DNA, 4197 bp, Homo sapiens
tggagacggagtctcgccctgtcgcccaggctggagtggcactggcgcgatctcggctcactgcaacctctgcctcttgggttccagcgattctcctgcgtcagccttctgagtagctggaattacaggcgtgtgtcgccacgcccagttagtgttttgtatctttagtagagatggggtttcaccatgttggccaggctggtctcaaactcctgacctcgtgatccgccctccccggcctcccaaagtgctgggattacaggcgtgaaccactgctcctggccgagctcaaagcttttatcaactggcccatgagtctgcactgagtcttgaggggggaggtgaaattaaatagccatagaaagtgctttttaacaaacttactgtgtttaaagaggaggaggaacccccagatgaagtaggtgacgagcactcttagaagttaccataaaagtgagtacagtgtgagctgtagatgtgtttgctgcagaggagcatgtgaggtttggaggcggatgtgtggtgactccaggggatagatttgcagaacctaacggaaagggaagctgtaaggtgcagggccagagggaaccagcagtaaccctgatagcggtctgtcatctgttcctctcgactctacagcagcggacaacagaactttgattgctgatttccatcagtaagcaggctttgaagcacacttccccacccctaaaaaaaaaccacgtattttggtaaatcctatatatattctaatgtactgtatgacagtatagaacatgatttttaaaagatgagttgggaggagaaaaggataaaagaaaaaaataaaagaagcattaagaataaacaattcggatctagattttactttctagatgattgactcgagggtggtgtagtaaaatcgcttgtctggtcacaaacatttggcagcagagcttttgattaggttctttgacaaagccttcagcacgttagagtggttttcactaatagtgttttggaaagaaaaggttgtccatagttctctagtttgctaagatgatcagctacccaggaacgtggagtaacttcctcttgtttgtgggagccccgggaatctgtgcaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316520 - DNA, 3355 bp, Homo sapiens
cttgtaatgggcacagaaatttcccatgtatttcccccacacaggcacagcctccctcatcatcagcatcccccaccagagtggtatgtttgttacagttgatgagccgacattgacacatcatcacctaaagtccatagtttacactagggttctctcttggtgttgtacatgctgtgggtttggacaaatgtataatgacatgtattcactattatggtgtcatacagaataatttctgtgcccatttcaacctaggggatccttaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316521 - DNA, 1531 bp, Homo sapiens
  misc_feature (1509)..(1509): n is a, c, g, or t
  misc_feature (1513)..(1513): n is a, c, g, or t
  misc_feature (1529)..(1529): n is a, c, g, or t
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaagagtggncggngatactctaaagtcgncc

SEQ ID NO: 316522 - DNA, 1640 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaatgccctgctttccaaaagcacacactttaccacgctcttaacagatccccaattccaagttgtaaatgctagtcttattccatactctatgtttctcaccattaaacacaggaaccaccagtctaaaactctttacaac

SEQ ID NO: 316523 - DNA, 3572 bp, Homo sapiens
cccgggctgcaggaattccggcacgaggagagagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttagccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316524 - DNA, 1787 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataaggatcccctaaggggatccttatttaaaatacagtgttagcatagatccccttttcaggaaggacccaaatgtcagtgcatagttagataaaacggtacaatgttttactgaaagcatacttttttggaaaatagattcatgaagcctttagtgctgcttctgtcagtcccaccttacaaactttaacattttctaagtgccccgaccgtgtaccaagacacatctaatggagattgtaccggttgtttttttgtttgaacctcttgaaagagttcaatcttaacgttttctcattttaaaatttaaaatcttgtttaaccaaagcttgtataagatactgttttcatttcattacagacttgtttataaaagttcattttttataagga

SEQ ID NO: 316525 - DNA, 3056 bp, Homo sapiens
tgctctagacgtactccccagttctggtccgccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316526 - DNA, 1399 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtgagaaggacgggccaggcgtggccagaaggagcgtggccagaaaggagcgtggccagaaggagcgtggccagaaggagcgtggccagaaggagcgtggcccgaaggagcgtggccagaaggagcgtggccagaaggagcgtggcagaaggagcgtggccaaagaa

SEQ ID NO: 316527 - DNA, 1292 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtgatgacaggtgtaccgccccagtcaaactccccacctggcatctatgcgacagcagaa

SEQ ID NO: 316528 - DNA, 1100 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacct

SEQ ID NO: 316529 - DNA, 1754 bp, Homo sapiens
  misc_feature (1)..(1): n is a, c, g, or t
  misc_feature (9)..(9): n is a, c, g, or t
  misc_feature (37)..(37): n is a, c, g, or t
ncaccaggngggctcggtcaagaactcccggatcccncgggctgcatgaattcggcacgttcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316530 - DNA, 988 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttaggaggaccgtccctaagaataagcacacatagataaatataatacgtacacctaaataagaccctaagtccatgaaagataacacgtgggacagccca

SEQ ID NO: 316531 - DNA, 1376 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcatgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgacgggcaattgggtaaacgtgccggctggtccaaatgaaccagtgcaggagcctggtaccaaattttataaacttccaggacatctggtcctattctctacattgtcctctgttt

SEQ ID NO: 316532 - DNA, 404 bp, Homo sapiens
aacaaatgaagcaatggggttggttgaacagctttggggggttcgattccttccttttttgtctagattttatgtatacgggttcttcgaatgtgtggtagggtggggggcatccatatagtcactccaggtttatgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316533 - DNA, 834 bp, Homo sapiens
cgcagactcgcgctccggtgtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttcccgggttaatgccattctcctgcctcagcctcccaaggtgttgggattacaggcgtgagccactgggccctgcctgtattttttatcagccacaaatccagcaacaagctgaggattcagctcataaaacaggcttggtgtcttggtgatctcacataaccaagatgctacgccgtggggaaccacatccccctggatgccctccagccttggtttgggctggagtcagggcctggatacagtattttgaatttgtatgccactggtttgcattgctggtcaggaactctagtgctttgcatagccctggtttggaaacatgttatagcagttcttggtatagagccaactagaagaaccagcatcattccactgtcctgccaggtacacctcagtactccccttcccactgaagtggt

SEQ ID NO: 316534 - DNA, 445 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtaccccgctgttcctgatcggctccaaggcgatcatcagcgagaacctgccggtgggccagcgggccaaggtgttttccctgcgctacaccctgaccaatgtcggctacgccaccggcccgatgctcggcgtggtgattgccgggcagatgcccctggcaccgttcctgatcgccagcgcgattgcctttggcagcctgttcctgatgatcggcatcccgccgacccaacgcgacgacagcaacaaacccttaagtttt

SEQ ID NO: 316535 - DNA, 254 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtaccccctgaacactctctgaacctgggctgaaccgaggccggctggctgtggttccttcacctggtg

SEQ ID NO: 316536 - DNA, 564 bp, Homo sapiens
tgtttcttgactgttactttgaattgttgtgagcttttgcaaatcctgttttctgcattagctgtttgcatgtatttagtaggttagaggtgggaactagagatcagagaattgtttatggcagcagagttagcagtaacttgagagggcatagctaagtcaaagacctacttccccacactacatcattagcaataacaattgctgaatgttcacaggatggcaatggttatatcagtgcagcagaactacgtcacgtcatgacaaacttaggagaaaaactaacagatgaagaagtagatgaaatgatcagagaagcagatattgatggagacggacaagtcaactatgaaggtaaaactaaattctctgagctcagtgtttcatagtcttacctttagatctgtaagcaagccaactgcttcactagacagcctttgactttattttatgtacagtaaagatgttgtgttcattaaagctgttttcaaagataaccaaaagttactattatatttgtcttttcagaattcgtacagatgatgactgcaaaatgaagaccta

SEQ ID NO: 316537 - DNA, 430 bp, Homo sapiens
tttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaatctaactgcgaactgtgtaggttt

SEQ ID NO: 316538 - DNA, 4261 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316539 - DNA, 4230 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316540 - DNA, 4654 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaaaaaaaaaaaaaaaaaaaaaaaaaaaaaaaaaaaaaagggggggggggtaaaaaattctcccggggggggcccaagttagcgggtaaccgagtttttgtggacaaggggggccccaatatagaggaggaggcgaatattatataagacctgaagccaggggcgccagctctattaaacaacgccgggacggcgggaacacacgtgtctagtggggactccttgtggagaaggaccccactaccctgggggcggcgaacattttgtggggacaactctcctaaggagaatttaaagggctggaggaactatcacagttaacgtgatgtgggtgtttaaaccagaggtattatcgtgagatgagaattgctacgggcagtgattcaaaattttcgg

SEQ ID NO: 316541 - DNA, 4416 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaaaacaaaactactacttaaccacccctattgccctaatatcccttccacatatcccactttccttcgaggggtccccttacccaactcccttataataagttcttttcaattcttgccctacttttaaaatgtcggctttgtaaaacccctggtaa

SEQ ID NO: 316542 - DNA, 4045 bp, Homo sapiens
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagca

SEQ ID NO: 316543 - DNA, 3971 bp, Homo sapiens
  misc_feature (3903)..(3903): n is a, c, g, or t
  misc_feature (3949)..(3949): n is a, c, g, or t
aaagggaacacaagctggcgctcacggatccttaattaaattaatcctccccccccccgggcagtggtgctgggagtgtcgtggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcacctgatttngtatccccctgtagcagcattactgaaatacataggcttatatacnatgcttctttcctgtatattct

SEQ ID NO: 316544 - DNA, 4314 bp, Homo sapiens
cgcaaagtttctgctccgggaggaggcggcggcgccgcgggctcgtcgcctgggggagcagaagcgggtgggaggtgcgggtggccttggcctcagccctggtgcgcgggggccgggggtggtgaccctcctggccgaggaggggcggcgtccagacgcccgctcgggggccgccttcccccccacgcctgcccccgggcacgcgccctgcccggtccctcgccccgcgccacttccagtccgcagagagatgccctccacgtttctgctttctctgcagcctctagattgccagatgcgactgtgcgcctcgctgggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316545 - DNA, 4086 bp, Homo sapiens
cccaggcagtggaagaaatacgactttcactacgacaatgtgctctgggctctgctgacgctgttcacagtgtccacgggagaaggctggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccaggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttcatctctaa

SEQ ID NO: 316546 - DNA, 948 bp, Homo sapiens
taggctagtcgaggcccgtgttaatcggccgaggagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacagacgctggggctaagacctggccatgccggacactatttcttggctacacagggaccttcctttgcttaaaggttttgccctttatcctccggttaccgtttcacacgca

SEQ ID NO: 316547 - DNA, 419 bp, Homo sapiens
gcagctcgtaccccgatatttgtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaaccacaaatatcggggtgcgagcagc

SEQ ID NO: 316548 - DNA, 2307 bp, Homo sapiens
cggacgcgtgtgtgacacacgcgagaagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttctta

SEQ ID NO: 316549 - DNA, 2376 bp, Homo sapiens
ctaacctaatacaccgggcccttttatgtgtcagcgacaaggcacctgagtgatggccgcacacttccagagccaccgtatgtgcctcgtgccgaagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttctta

SEQ ID NO: 316550 - DNA, 2338 bp, Homo sapiens
tcatcgctgtctggaacagcgatgactcgagagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaatatgataaaacaccaaaaagg

SEQ ID NO: 316551 - DNA, 2890 bp, Homo sapiens
tcatcgctgtctggaacagcgatgactcgagagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaacacaaaaacaaaccaacacacaacaacaacaaacacacaaaaacaacacaaaaaaaaaaaacaccacaacacaaacacaaacacaacaacacaaaaacaacaaaaaaaacaacgacagggggggggggaccaaagacgccgcgcgcgagcaccagtagagcaccacagatacaggagaggagcgcacaaacaggggaataaacaacagagcggagcctagaatccacgcagccgaccgagagacaaaaagacagcgacgaaatcaaagaagagacccacacataggggaagacaaaaagaggagcacccaccgagaacaaacagacgcgagaacaacaccacagctgtagcggcaaccaaacagcagtggcaagacaaagactccgggagaaatttaaaaatgacaaggcaggaaaatacagcaaagagcaagaagagagagggacgacgaaacgagaagggaggaagcgaggtgatagaaaaagagatacgaaagaagaggaacgtgaaacgagtagaatacgaacgacacaagaaagacgaaacaaggcaaagagcgcagcgcacatcttcta

SEQ ID NO: 316552 - DNA, 2301 bp, Homo sapiens
  misc_feature (53)..(54): n is a, c, g, or t
  misc_feature (57)..(57): n is a, c, g, or t
tcacaacacaccacaccacaccaacgaaaaaactacggctaggtagcgaggcnnggngttgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttctta

SEQ ID NO: 316553 - DNA, 2240 bp, Homo sapiens
tcatcgctgtctggaacagcgatgactcgagagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttctta

SEQ ID NO: 316554 - DNA, 2264 bp, Homo sapiens
cggacgcgtgtgtgacacacgcgagaagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaacctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttctta

SEQ ID NO: 316555 - DNA, 276 bp, Homo sapiens
ttgaagggttgctgactgatttcatagcatatactgttaaaatgctttgccttgtgttttcagcagcagatcatacagtgatactttcacccttgagtggctcatgtgaggataccaacctaaatgagtttacctcttagagaagatgtcagtggttgttttcagtcccatcctctcacttctctctggcttcttttttaggacgtggagaacagcttcttcttgaatgtcaattcccaagtaacaacagtgtgtcaggcacttgctaaggatcct

SEQ ID NO: 316556 - DNA, 2312 bp, Homo sapiens
tcatcgctgtctggaacagcgatgactcgagagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttctta

SEQ ID NO: 316557 - DNA, 2315 bp, Homo sapiens
taggctagtcgaggcccgtgttaatcggccgaggagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttctta

SEQ ID NO: 316558 - DNA, 2614 bp, Homo sapiens
tcatcgctgtctggaacagcgatgactcgagagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttaaaaaaaaacaacaaaccacacgaacaaaaaaacaagagaaaaacagacggcacggaccaaaacaaagcaacaacaaccaacacaaaaagacacgaacccggaagagcacaaaacaacaagaaaaacaaaaaagaccagaaagaaagcataatatatatgcggggcaagagaccagccagaacagacagagaaaggaaaaaaaaagaaaagaaacgaaaaaaagggagaaaacaaaggagagaggaagacaggggagacacaagaaaaacaccaggagcatagcaaccccaaaccacgaagat

SEQ ID NO: 316559 - DNA, 2232 bp, Homo sapiens
tcatcgctgtctggaacagcgatgactcgagagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcccaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttctta

SEQ ID NO: 316560 - DNA, 2250 bp, Homo sapiens
cccatgggaccttggcagcttcattcgggcagcatgacagcactacatttgtggaacctcgcacgtgacagccgtgcgctggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttctta

SEQ ID NO: 316561 - DNA, 1276 bp, Homo sapiens
tcatcgctgtctggaacagcgatgactcgagagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaaccacaaatatcggggtgcgagcagc

SEQ ID NO: 316562 - DNA, 808 bp, Homo sapiens
tcatcgctgtctggaacagcgatgactcgagagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggatttcacagaagtgggagtcgagctcgacttggtaa

SEQ ID NO: 316563 - DNA, 2011 bp, Homo sapiens
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaa

SEQ ID NO: 316564 - DNA, 2955 bp, Homo sapiens
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaacttggatgttggcttgactgtgtttgtcccttcagatggcaagtcagcatcattctttatattcctcttctcattggggttttctgaactctggcaggcggttgaagtagtttctcactgtggattaattctagcaatctcttttcacccctctgcctttccaaaacattgacaagactcatttccagttaattaattcgagaaccctccctcttcattttgggtactgggctgtcttgtcactgagccctatccctttggaatgtggcagggagtgaggttggtgagagaacatgtgggcacttaactcttcatgttccagttcatcccagaagtagacatcccaggacccattctgtgtcaaggtgaatgcctgtgtcctccccagcttcatgcctctgtcatgggggaaggaatagcttatgttctgctctggtgcagtgccgtagattaaaggtacatttctatcttctttgatttaaaaagcaccagtctcataaaggtgccactcagttttagccatgtcttcactgaaattgcaaaagtacttttagggagcaggagtttatttgacatctagttatctgtctgtctgttcatctatctatctgtctgctgtatgagaggtaggactggattaaatgaccactgaactcactgaatccagatcattcatatcatcaacaaaagctctagggggaggtcacgttgtgaatgcttaaaacatattattttcttcaacaaccatatcgctaaactaatatatccagagattttgcacaattcgtgttgaaccttccaaaacaaaaataaagacctgtccaaaagttttgacaaaaatactgattgctcccaaataaagtgcttctaagctttgtgtagaaaatacatcaaaataaaactccagggggggccccggtaccccaattggcctataagggag

SEQ ID NO: 316565 - DNA, 2443 bp, Homo sapiens
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaaaaaaaaaaaaaaaaaaaaaaaaaaaaaaaaaaaaaaaaaaaaaaagaaaaaaaaaaaaagaaagagaaaaaaaaaagaaaaaacaaaaaaaaaaagaaacaagcggggaagggcggtatacaggggggagcaacaacaaccgcataacatagcaaacaggaaaaacggagagggaagcccgaaacgaacaagcaactagaacaacacaacaagcacagaagcaggcaccagaggccgaacagatcccagcgccaaacggatacacatgtcaagaagaacataaacacagcgagagcagcagacgatcgagcaaggaacaacgaaagagcacaccaagcacacagtgctgaagctggtaaaaggacacaataaacacacgcaccaaaacgaaaacacagaagcgcagaaaaacacacgcaaacaaaaacccg

SEQ ID NO: 316566 - DNA, 1926 bp, Homo sapiens
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggaccttcggcgtgtggggtaccgag

SEQ ID NO: 316567 - DNA, 3249 bp, Homo sapiens
tccggccggggggctgccccgggcaggggagggcggccgggactcccgcggcggccccggcctggacccaggcgccgcccccgcctcgctggagacgcggagggcgaggcctgcgcgggctgcctgagcgccacccaggcctcccgactcccaggcaccgcctcgtgctcgtgggtccccgcggggcctggggcgggcgccccgctcccccaccgcagccagtccgggtgcgaagccgcgatcccgggagcccttgccgcggcgtgccggtgatgttgacccaacacacgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaacttggatgttggcttgactgtgtttgtcccttcagatggcaagtcagcatcattctttatattcctcttctcattggggttttctgaactctggcaggcggttgaagtagtttctcactgtggattaattctagcaatctcttttcacccctctgcctttccaaaacattgacaagactcatttccagttaattaattcgagaaccctccctcttcattttgggtactgggctgtcttgtcactgagccctatccctttggaatgtggcagggagtgaggttggtgagagaacatgtgggcacttaactcttcatgttccagttcatcccagaagtagacatcccaggacccattctgtgtcaaggtgaatgcctgtgtcctccccagcttcatgcctctgtcatgggggaaggaatagcttatgttctgctctggtgcagtgccgtagattaaaggtacatttctatcttctttgatttaaaaagcaccagtctcataaaggtgccactcagttttagccatgtcttcactgaaattgcaaaagtacttttagggagcaggagtttatttgacatctagttatctgtctgtctgttcatctatctatctgtctgctgtatgagaggtaggactggattaaatgaccactgaactcactgaatccagatcattcatatcatcaacaaaagctctagggggaggtcacgttgtgaatgcttaaaacatattattttcttcaacaaccatatcgctaaactaatatatccagagattttgcacaattcgtgttgaaccttccaaaacaaaaataaagacctgtccaaaagttttgacaaaaatactgattgctcccaaataaagtgcttctaagctttgtgtagacatagtttaactgatttgtaaaaatagcttaagcatgttgagaatgaagtaaaagttttcccatgtgctgtctaatgtactctgtgtaactctgaagacacatcagcttctaggattgcagcaatctatgaataacattttttctctcatttatgactttccatcagtaaagaagccattgcagaatttaaaattacacaaaggagtcattctctcctgggacataaagagttaaagctctgtcctctaaatagaagcctggccaaagggagaaaacagtgggagtcccttttcccttttaacaagtttgcaatagacacttctttttttcctgtctcaatggatgtgtgcacaccagtggaatcgcacaaacttgtcggtatgagctatataataacaaacacaaataaataaaagggagccttgtgagaatacaaatggggtaa

SEQ ID NO: 316568 - DNA, 1687 bp, Homo sapiens
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctgtatccttgcatgtgaattaccatgcacaagtttacagccggggcccttagcaaaacaagtcccttgcctcatgttcattcatgccaccatccagtccacacttgcatcattgctggccctgaacttcggcagtgacttcctaactcatctttcagtttctgctcctgctgggtccaggtgattt

SEQ ID NO: 316569 - DNA, 1360 bp, Homo sapiens
  misc_feature (1304)..(1304): n is a, c, g, or t
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttattgcggtgattcatgtaacttgagctccanacattttaggtaattgtggtgctttagagcagtgtgacatttccattgttgcctgt

SEQ ID NO: 316570 - DNA, 2388 bp, Homo sapiens
  misc_feature (30)..(30): n is a, c, g, or t
tgccggaccaacatgcgaacggactgatcnatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaacttggatgttggcttgactgtgtttgtcccttcagatggcaagtcagcatcattctttatattcctcttctcattggggttttctgaactctggcaggcggttgaagtagtttctcactgtggattaattctagcaatctcttttcacccctctgcctttccaaaacattgacaagactcatttccagttaattaattcgagaaccctccctcttcattttgggtactgggctgtcttgtcactgagccctatccctttggaatgtggcagggagtgaggttggtgagagaacatgtgggcacttaactcttcatgttccagttcatcccagaagtagacatcccaggacccattctgtgtcaaggtgaatgcctgtgtcctccccagcttcatgcctctgtcatgggggaaggaatagcttatgttctgctctggtgcagtgccgtagattaaaggtacatttctatcttctttgatttaaaaagcaccagtctcataaaggtgccactcagttttagccatgtcttcactgaaattgcaaaagtacttttagggagcaggagtttatttgacatctagttatctgtctgtctgttcatctatctatctgtctgctgtatgagaggtaggactggattaaatgaccactgaactcactgaatccagatcattcatatcatcaacaaaagctctagggggaggtcacgttgtgaatgcttaaaacatattattttcttcaacaaccatatcgctaaactaatatatccagagattttgcacaattcgtgttgaaccttccaaaacaaaaataaagacctgtccaaaagttttgacaaaaatactgattgctcccaaataaagtgcttctaagctttgtgtagacatagtttaactgatttgtaaaaatagcttaagcatgttgagaatgaagtaaaagttttcccatgtgctgtctaatgtactctgtgtaactctgaagacacatcagcttctaggattgcagcaatctatgaataacattttttctctcatttatgactttccatcagtaaagaagccattgcagaatttaaaattacacaaaggagtcattctctcctgggacataaagagttaaagctctgtcctctaaatagaagcctggccaaagggagaaaacagtgggagtcccttttcccttttaacaagtttgcaatagacacttctttttttcctgtctcaatggatgtgtgcacaccagtggaatcgcacaaacttgtcggtatgagctatataataacaaacacaaataaataaaagggagccttgtgagaatacaaatggggtaa

SEQ ID NO: 316571 - DNA, 679 bp, Homo sapiens
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtcagaaagagcagcggaaccgataaacagtacccaggactatcttccaaagatgttctggatatcctaaagaaatcttctcatgctgttgagcttgcctgcagagatccatcccaagtggaaaacctggcttccagtctgcagttaataacagaa

SEQ ID NO: 316572 - DNA, 396 bp, Homo sapiens
gtgaaccagaattcaatcaggtagttacacacgtaccttggattctgtttctttgtatatgtgcatgctggttctgtcatttggtttatctgttagaagttgttttgggctgggtaaggtggctcatgcctgtaatcccagcattttgggaggctgaggcaggaggattgcttgagtccaggagttcaagaccggcctgggcaacatggtgagaccctgtctctacaaaaaaaatacaaaaaattagctggacatggtggcgcacacctgtagtcccaactgctcaggagactgaggtgggaggattgcttgggccagggagaggcagaggttgcagtaatctgagatgatgccattgctgcaggctgggccacattgtgagaccctgtctcaggg

SEQ ID NO: 316573 - DNA, 507 bp, Homo sapiens
agatagttaatgttcactatagtttaaaaaacagaactccttgaataatattgcatgaattgttttaggtttctctaagttatttgtcaccactgaccaaagttctgggttttttccccttttgtctgatgaatcttgtgaacagatttgctacatctgcaattttgtttctttcttcttctttagtgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaa

SEQ ID NO: 316574 - DNA, 368 bp, Homo sapiens
aagtaatggacataaaaggtgcattaagcaattctagtttctgtggccaagacacatcaaagaaatgaagaatttaaaaaataggtgattgatgaagattaactttattcatgtttttcctagctagacattagaagcaaggtaaggaatttaaaataataatattcccttaaagttgctttcctaggtatttttagcattgtataatttaagtattatagattcatgcagaaatcctttatgttttacagagttacactgttagaccttatgatagccaagataacgagtgatgagccactcaccaaggatgacatccctgtgtttttgcggcatgctgagttgattgcaagcacctttgtggatca

SEQ ID NO: 316575 - DNA, 3341 bp, Homo sapiens
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaacttggatgttggcttgactgtgtttgtcccttcagatggcaagtcagcatcattctttatattcctcttctcattggggttttctgaactctggcaggcggttgaagtagtttctcactgtggattaattctagcaatctcttttcacccctctgcctttccaaaacattgacaagactcatttccagttaattaattcgagaaccctccctcttcattttgggtactgggctgtcttgtcactgagccctatccctttggaatgtggcagggagtgaggttggtgagagaacatgtgggcacttaactcttcatgttccagttcatcccagaagtagacatcccaggacccattctgtgtcaaggtgaatgcctgtgtcctccccagcttcatgcctctgtcatgggggaaggaatagcttatgttctgctctggtgcagtgccgtagattaaaggtacatttctatcttctttgatttaaaaagcaccagtctcataaaggtgccactcagttttagccatgtcttcactgaaattgcaaaagtacttttagggagcaggagtttatttgacatctagttatctgtctgtctgttcatctatctatctgtctgctgtatgagaggtaggactggattaaatgaccactgaactcactgaatccagatcattcatatcatcaacaaaagctctagggggaggtcacgttgtgaatgcttaaaacatattattttcttcaacaaccatatcgctaaactaatatatccagagattttgcacaattcgtgttgaaccttccaaaacaaaaataaagacctgtccaaaagttttgacaaaaatactgattgctcccaaataaagtgcttctaagctttgtgtagacatagtttaactgatttgtaaaaatagcttaagcatgttgagaatgaagtaaaagttttcccatgtgctgtctaatgtactctgtgtaactctgaagacacatcagcttctaggattgcagcaatctatgaataacattttttctctcatttatgactttccatcagtaaagaagccattgcagaatttaaaattacacaaaggagtcattctctcctgggacataaagagttaaagctctgtcctctaaatagaagcctggccaaagggagaaaacagtgggagtcccttttcccttttaacaagtttgcaatagacacttctttttttcctgtctcaatggatgtgtgcacaccagtggaatcgcacaaacttgtcggtatgagctatataataacaaacacaaataaataaaagggagccttgtgagaatacaaatggggtaa

SEQ ID NO: 316576 - DNA, 2836 bp, Homo sapiens
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaacttggatgttggcttgactgtgtttgtcccttcagatggcaagtcagcatcattctttatattcctcttctcattggggttttctgaactctggcaggcggttgaagtagtttctcactgtggattaattctagcaatctcttttcacccctctgcctttccaaaacattgacaagactcatttccagttaattaattcgagaaccctccctcttcattttgggtactgggctgtcttgtcactgagccctatccctttggaatgtggcagggagtgaggttggtgagagaacatgtgggcacttaactcttcatgttccagttcatcccagaagtagacatcccaggacccattctgtgtcaaggtgaatgcctgtgtcctccccagcttcatgcctctgtcatgggggaaggaatagcttatgttctgctctggtgcagtgccgtagattaaaggtacatttctatcttctttgatttaaaaagcaccagtctcataaaggtgccactcagttttagccatgtcttcactgaaattgcaaaagtacttttagggagcaggagtttatttgacatctagttatctgtctgtctgttcatctatctatctgtctgctgtatgagaggtaggactggattaaatgaccactgaactcactgaatccagatcattcatatcatcaacaaaagctctagggggaggtcacgttgtgaatgcttaaaacatattattttcttcaacaaccatatcgctaaactaatatatccagagattttgcacaattcgtgttgaaccttccaaaacaaaaataaagacctgtcca

SEQ ID NO: 316577 - DNA, 2044 bp, Homo sapiens
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaagttaccattcaaaatgatttggaaacatctcga

SEQ ID NO: 316578 - DNA, 1528 bp, Homo sapiens
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtggatgaacagatagacgaataggtggataagtggataggtggatggatggatgttggaggggggtctcaaaa

SEQ ID NO: 316579 - DNA, 2497 bp, Homo sapiens
catagatgcttaccaaaaacaatcctgaatcagaatgcttaccaaaaacattctgattcaggatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaacttggatgttggcttgactgtgtttgtcccttcagatggcaagtcagcatcattctttatattcctcttctcattggggttttctgaactctggcaggcggttgaagtagtttctcactgtggattaattctagcaatctcttttcacccctctgcctttccaaaacattgacaagactcatttccagttaattaattcgagaaccctccctcttcattttgggtactgggctgtcttgtcactgagccctatccctttggaatgtggcagggagtgaggttggtgagagaacatgtgggcacttaactcttcatgttccagttcatcccagaagtagacatcccaggacccattctgtgtcaaggtgaatgcctgtgtcctccccagcttcatgcctctgtcatgggggaaggaatagcttatgttctgctctggtgcagtgccgtagattaaaggtacatttctatcttctttgatttaaaaagcaccagtctcataaaggtgccactcagttttagccatgtcttcactgaaattgcaaaagtacttttagggagcaggagtttatttgacatctagttatctgtctgtctgttcatctatctatctgtctgctgtatgagaggtaggactggattaaatgaccactgaactcactgaatccagatcattcatatcatcaacaaaagctctagggggaggtcacgttgtgaatgcttaaaacatattattttcttcaacaaccatatcgctaaactaatatatccagagattttgcacaattcgtgttgaaccttccaaaacaaaaataaagacctgtccaaaagttttgacaaaaatactgattgctcccaaataaagtgcttctaagctttgtgtagacatagtttaactgatttgtaaaaatagcttaagcatgttgagaatgaagtaaaagttttcccatgtgctgtctaatgtactctgtgtaactctgaagacacatcagcttctaggattgcagcaatctatgaataacattttttctctcatttatgactttccatcagtaaagaagccattgcagaatttaaaattacacaaaggagtcattctctcctgggacataaagagttaaagctctgtcctctaaatagaagcctggccaaagggagaaaacagtgggagtcccttttcccttttaacaagtttgcaatagacacttctttttttcctgtctcaatggatgtgtgcacaccagtggaatcgcacaaacttgtcggtatgagctatataataacaaacacaaataaataaaagggagccttgtgagaatacaaatggggtaa

SEQ ID NO: 316580 - DNA, 936 bp, Homo sapiens
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggcccctcccctaggagacagaagagca

SEQ ID NO: 316581 - DNA, 2751 bp, Homo sapiens
gggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggcttta

SEQ ID NO: 316582 - DNA, 2682 bp, Homo sapiens
gggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggcttta

SEQ ID NO: 316583 - DNA, 1188 bp, Homo sapiens
gggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtaggtgtggccgcgtcccctacccggccgggactttctggtaaggagaggaggttacggggaacgacgcgctgctttcatgccctttcttgttctaccttcatcggccgaggtaaaagtgctgaaaccatgtgaataaaatacaggtgggttccgccagcttcgctcctgaacctacccgcgctcgggatccagaagctgcgccgggagagaggggctcaggcctgggcggaggggacggaggtcagaccgtgcggaaagtgacccgggcaccccagggcgcccaggcccccagggagcgcggaaagtgcggtcgcggcccggccctcgggagacgcgggattgggatcaggcacagcgcgaggaagtcgatcttggagctagaacattttcctttggccatttacacgaatccactggaaaatgccgcagtgtttatcaaagttactcaaagtagaaatgtccagacgtcttatgagcttagacaaatcttttactacaaaaagaaacagcagttgcattcaaacaacaacccttctgaaccactactaaaatttagcataattactcttgtggatacattttcattgtcaagtaatttacttagccaatgaacttggagagcaagaaagttttatgtagtaaaatgtaaatttgagttaagagttaagggtgtttctttttgtctgtttgtctgtttttggcaatgtggctccaaaaccttaagcccacctaaaaactatataaatgcaatccattcttttgttggaatgttcaaggactagaaagacaattggagaagtgagagtttgaatctttttttacgttggaaacagtgttgcaaaatattttttgagttttgcctgacttagcaaagattcagtcgaactcaagtagagttcaaagcattgcagcgtgtagtaa

SEQ ID NO: 316584 - DNA, 488 bp, Homo sapiens
tgagatacaggccaacgtggtcagtcagttgtccagagaaggtaaagaactgtctttgggatgtgtcaaccttgttccctcgagggggtctggtcaaggtggctcagtggggcagttgtccctgggggaaatgatcccctggtcacctctcagtgtccctacagagatgcttaccttggaaacataaccagaaacagcgatgcagcctcatggtttggcaattggtgaatccccagccgacttcgtaaacttttcctagatttagaagcgttttctctgcatgtccatctattcaaaggaatttcctcagacttcactgtcataccttgtattttaaaaatgatcttagctgagtgcagtggcacgcacctgtagtcccagctactcctggcaggaggatcgcttcatcctcactatgatctcactatcgtttgaggctagtttgagaccagcctgggcaacatagtgaggccctgtctcaaaaaaag

SEQ ID NO: 316585 - DNA, 5179 bp, Homo sapiens
gggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatgattttca

SEQ ID NO: 316586 - DNA, 5152 bp, Homo sapiens
gggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcttttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatgattttca

SEQ ID NO: 316587 - DNA, 4522 bp, Homo sapiens
gggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagctccctccactggttagcagtgtgttgtgttttccattcatttcagaagagctacattgtgtcactggacatttttaaaaactgtgatttttaataaaaatttaaaatttgctttgtgatgattttca

SEQ ID NO: 316588 - DNA, 5325 bp, Homo sapiens
gggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtaggtgtggccgcgtcccctacccggccgggactttctggtaaggagaggaggttacggggaacgacgcgctgctttcatgccctttcttgttctaccttcatcggccgaggtaaaagtgctgaaaccatgtgaataaaatacaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatgattttca

SEQ ID NO: 316589 - DNA, 5291 bp, Homo sapiens
gggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtaggtgtggccgcgtcccctacccggccgggactttctggtaaggagaggaggttacggggaacgacgcgctgctttcatgccctttcttgttctaccttcatcggccgaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatgattttca

SEQ ID NO: 316590 - DNA, 4997 bp, Homo sapiens
gcctgtcttgtgctttctctctgtttcagctgttttccttttaagatactcctctcagatttgtgtgcttcttcccttcccacattctatactgcccagcgcctgggattccagatctgcgtttgaatccaggaaagggaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtccctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatgattttca

SEQ ID NO: 316591 - DNA, 3375 bp, Homo sapiens
tgctgggattacaggcatgaaccaatgtgcccggcccacaattttattcttaatggaatttctccctctgctttgcttttaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatgattttca

SEQ ID NO: 316592 - DNA, 2546 bp, Homo sapiens
gcctgtcttgtgctttctctctgtttcagctgttttccttttaagatactcctctcagatttgtgtgcttcttcccttcccacattctatactgcccagcgcctgggattccagatctgcgtttgaatccaggaaagggaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtccctactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatgattttca

SEQ ID NO: 316593 - DNA, 535 bp, Homo sapiens
tgaccctgggaagaggccatgcattgccatttgacaacatgcatgctggcctgttctaaagacatttctaaccaaagctatcacttgtgacccagtgtttattttgcccagtctaactctaaaatgaacactctttttgggcaccgagggatgtaatatttaaagaaaatgtgattcagccccatattctccttttaatggcaaattataggttgcatagcacattctgtggttatccaactaaaattaaaatactgcagtttttttactcaaactacccccttgatctcagactttacttctattttacatgaaacaagatgccaacaggaaagatgttaaggaaaagttcctgggagtagcatccatgagtggtgagtgcaggtttgaagacttcagccttaggcccacagtcattagagggtctgtctgaatcctgggttctgtttgctatcctcagtggttcagtgtaaatctaaattgtagaaggttctgagatacaggccaacgtggtcagtcagttgtccagagaagg

SEQ ID NO: 316594 - DNA, 220 bp, Homo sapiens
gagggggttagtggtgcgattatagaagcaaatttaagtagcatgtcgtggaagggatcctgtatttgttttctgaaacatttactgttcctctttgccgttgtggtttctagacttggtcagcgggtggaataatctcaagaatcaaatcatactccttcccaaagcctggccacagaaaggtgctaaagcaacccctgcttgctgtccaactaagtgg

SEQ ID NO: 316595 - DNA, 525 bp, Homo sapiens
cgagagcccctacgcggaccccgaggagatcaggcccaaggaggtttacctggaccgaaagctgctgacgctggaagacaaagaactgggctctggtaattttggaactgtgaaaaagggctactaccaaatgaaaaagtaagttgctatgttccaccagcctcaccctcacatgagctcaggttctagacatgactgagaataacaaaatgtaacctggcatgactaaaccctttttttattaatgctaccattcttgttaatttctggtactattataatgaaagcgtccattacctttaatggcaaaaactgcaattacttttgcaccaacctaatagtacatgcaccttatggaaaattaggaaatagaaacaagcagaaacataagaaaataaaaacatcaaattggcatggtggctcatgcctgtaatcttagcaatttgggaggctgggataggaggattgtttgaggcctggagcttgagaccagcctgggcaacatagcaagaccctgtctctaca

SEQ ID NO: 316596 - DNA, 472 bp, Homo sapiens
cgattctactgcctcagcctcccaagtagctgggattacaggcatgtgccaccacacctggctaatttttgtatttttagtagagatggggtttcaccatgctggccaggctggtctcgaactcctgacctcaagtgaaccatcctccttggcctcccaaaatactgggattataagcgtgagccaccgtgcccggccatgttatttttatttatacacttgaaagtacttaagtaatgtgtaaaggtctttctggttttatttactgaatgaatgagtgaataagttttgatcctgttttaccatgccaggactcgagatagattggaaatgccttctgcatcattttcatttttcctcggtatggtttactctgctttgctctccatgtggcagggtcaggctctggagcaggccatcatcagtcagaagcctcagctggagaagctgatcgctaccacagcccatgaaa

SEQ ID NO: 316597 - DNA, 2628 bp, Homo sapiens
gcctgtcttgtgctttctctctgtttcagctgttttccttttaagatactcctctcagatttgtgtgcttcttcccttcccacattctatactgcccagcgcctgggattccagatctgcgtttgaatccaggaaagggaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggcttta

SEQ ID NO: 316598 - DNA, 5125 bp, Homo sapiens
gggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgattctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatgattttca

SEQ ID NO: 316599 - DNA, 5056 bp, Homo sapiens
gcctgtcttgtgctttctctctgtttcagctgttttccttttaagatactcctctcagatttgtgtgcttcttcccttcccacattctatactgcccagcgcctgggattccagatctgcgtttgaatccaggaaagggaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatgattttca

SEQ ID NO: 316600 - DNA, 5222 bp, Homo sapiens
gggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtaggtgtggccgcgtcccctacccggccgggactttctggtaaggagaggaggttacggggaacgacgcgctgctttcatgccctttcttgttctaccttcatcggccgaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatgattttca

SEQ ID NO: 316601 - DNA, 1133 bp, Homo sapiens
gggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtaggtgtggccgcgtcccctacccggccgggactttctggtaaggagaggaggttacggggaacgacgcgctgctttcatgccctttcttgttctaccttcatcggccgaggtaaaagtgctgaaaccatgtgaataaaatacaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgtgagtatcgtgccttccccctcacctcctgccaccaggcctgtgtggacaattgggaataattcagcttccttgtgactggccccacatgaccctgggaagag

SEQ ID NO: 316602 - DNA, 1330 bp, Homo sapiens
cgctcccctcttccggaagtcgcgccggtgcgcgccggactcctcccaccagcggcgacgtcaaactcagctcctaccacttctctgtctctgccgaccggcgcagggagggctgccttttccttacagtacgccttgaggcttccgggccgctgaagtttacgagcgagggcagtgcagttactcagtgtgccggcctcggacgcacgtgagtagagtttgagaagacagaggctggctcccggcaggccacgcccgcagaggcctttccccctctccacaacttgtgttctacttggttccgccgagacccacgacggttccgcccccttcttcctagtcattgatgttgttgttcttgtcagtgccgcagccccgaccgccgggagctcgaacccgagccggggccgcccgggtggcgcggtggcggcggctgcggctgcagcagctgcgacggctgcgggggctgctccgggtactgcgggggcggccgggagccggcagccggcggcggggccggatggctctgtgcgggcaggcggcgggcgctgcgtcgctgcccagcgagctgatcgtgcacatcttctcttttctgccggcgcccgaccggctgcgggcctcgggcctcctgctcgcactggcgtgagtgcctcttctatccggccctgtggccccagctccgcatctgcctccgcgtctcgcccgcggagcagcctcggctggaattcctcatgcgcaagtgcggctggttcgtgcgagagctgcgtgttgaattcgccgccgagaactatctgagcggcggtgggcccaggggacggaggtggcgcggacaccgggactggaggggaggaagtcgaggccctgcagctctcagctcgttggctggaagtgctgcgcacctacttggagctggtgctttgcgtgctggtcagcatccggaacaacaggaaccttcagaagtttagtctttttggagacataagtgttctacaacagcaaggaagtttgtcaaatacatacctcagcaaggtggaccctgatggcaaaaaaattaaacagcaactgaaatggctgtcctgtgggtttatgctggaaatagtaaccccaacatcactgtcatctctctctaatgctgttgccaacaccatggagcacctcagtttactggacaataatattcctggtaacagcactcttattactgcagttgaactggagcgatttgtgaatctgcactcacttgccttggatttttgtgactttacagctgagatggcaagagtcttaactgatagcaaccatgtgcctttgcaacgactgtctcttctgg

SEQ ID NO: 316603 - DNA, 3088 bp, Homo sapiens
cgctcccctcttccggaagtcgcgccggtgcgcgccggactcctcccaccagcggcgacgtcaaactcagctcctaccacttctctgtctctgccgaccggcgcagggagggctgccttttccttacagtacgccttgaggcttccgggccgctgaagtttacgagcgagggcagtgcagttactcagtgtgccggcctcggacgcacgtgagtagagtttgagaagacagaggctggctcccggcaggccacgcccgcagaggcctttccccctctccacaacttgtgttctacttggttccgccgagacccacgacggttccgcccccttcttcctagtcattgatgttgttgttcttgtcagtgccgcagccccgaccgccgggagctcgaacccgagccggggccgcccgggtggcgcggtggcggcggctgcggctgcagcagctgcgacggctgcgggggctgctccgggtactgcgggggcggccgggagccggcagccggcggcggggccggatggctctgtgcgggcaggcggcgggcgctgcgtcgctgcccagcgagctgatcgtgcacatcttctcttttctgccggcgcccgaccggctgcgggcctcgggcctcctgctcgcactggcgtgagtgcctcttctatccggccctgtggccccagctccgcatctgcctccgcgtctcgcccgcggagcagcctcggctggaattcctcatgcgcaagtgcggctggttcgtgcgagagctgcgtgttgaattcgccgccgagaactatctgagcggcggtgggcccaggggacggaggtggcgcggacaccgggactggaggggaggaagtcgaggccctgcagctctcagctcgttggctggaagtgctgcgcacctacttggagctggtgctttgcgtgctggtcagcatccggaacaacaggttacacggtgtgggcacacaacctcattgccattgctcgtcttcggggctctgatctgaaagtgcttgaagtcaccgaagaaagcattgattttgaccaaggtgaactggccgaccaggatgtagatccagtgcataaccttattgagcaggtatccctgggcctgggtcaaccttggcatgcagtcatggacatcgaatcactcagtgtcttcactgaaccaaatcgtcatttttacagagagatgcaaagcttcagtgaagacatttagcttttttttaatgtagaattcctgtggttacatatgcaagtagggtcctattatgtttttttttcagtagtgtgaattaatccttttgtgctgtgtttaatcagtattagctttatagaattatatatgtatattctacttcttgatcaaagaacgtagtcgggtattggtttagaagttcaaagtgacaatgtatagggctttcacggttaatggacttgttaccaaaccttaaggatatacagccgaagattgtctgaggttgctggctaactttatttttcactgagttactctgcctttttgacgtttttattctttgtgtgtcagagttcagagctcaggagccaaaatatttttatacatatatagatatatatccatagcctggtagatttatatgcaatgcactgcatccatgcattctgatagcatttcattaattttgatttcaaatggaagataaataatatcccaaatgaattatctgtaacagaaaagccaagactttaactttcattacatatctaatagttgatatcaccagttaccattttgaattttgtatagtactaggttagaacattgcttaatccttttaaaaaaaatgcatttacgtaaacacgaatactgaaattgttggattttttaactatatctgacataattttattcatcaattacattacacattcatttagcccagatttcaaatagtgggggaagaaagaaactgtatttcagagtaaaatctcctaaaggaaataaaaacacagagttgtaaatacacatgcttgcaaaaacattagtcgtgaaatccctagcaacaagtcactggatttttctctgtcagcacgcgtgtcagctgccaaagaatagacttaatgaagaagtgcccacatgctggcaggggccggcccactctggccagccagatactgctagattgtaatatttaaggtcgaatttcgacctgtggtacacagctgtgctgtggctcagtcagcaacctcagaactctgaaaaaacaaaacaaaaaaaaaaaaaaaagaaaaaaaaaaaaaacatgcacctgtttcactgtgaatagtgaatgtaaaggaaagaaaggaaaaactgaaagcttgttctatcacaggtatgagctgctatgatacatgaagaacattccatgaagtatgttttaaaaccttgttatatctgagaggctttaaaagcctattaactgtttcagggcaaccgcggtacagacgtggtctctgtgagacttccacctgaccccagttttaagtggtacgaatgttgtgcatttaatgttaaaggacagtctgcaataataaagtaagtagccaacctgggtgcccagcagtgctgagacctggctgctctattgtaagctttggaaacacaatttatgcaacagatgtccagatatgattctatttatggaaaaaagtttatatgtgttttacaaatggttttaccatcttatattaaaatgaccttttgacaggtgtgcactgttttgtctccagtgagcacataccatgcggattttatatgtacatcagtagtgtgaatccactggcacagtgtgtgtaaatgccagatgtggtgagattttatcttataaatgtgatcagataaaataactcctgacagaaactgtaaggaaaccagctgaatgtttgacctgatgactgatgttgtatggtttatgttaaatgtatattcttttaatcaatgaataaagcattaaaaatgatcattgtaatatattttattgtatatgaagcatgactacttttagtgttaaataaactgcaataatccttatattgtgtataataatgtgttagtattctggtt

SEQ ID NO: 316604 - DNA, 869 bp, Homo sapiens
cacaggttgcaagcctcgcacggttgactttagagggttccccccgttagagcggtttgtaaaaaaataataccagaaaaaccaaacggaaaaaaaaacatgcacctgtttcactgtgaatagtgaatgtaaaggaaagaaaggaaaaactgaaagcttgttctatcacaggtatgagctgctatgatacatgaagaacattccatgaagtatgttttaaaaccttgttatatctgagaggctttaaaagcctattaactgtttcagggcaaccgcggtacagacgtggtctctgtgagacttccacctgaccccagttttaagtggtacgaatgttgtgcatttaatgttaaaggacagtctgcaataataaagtaagtagccaacctgggtgcccagcagtgctgagacctggctgctctattgtaagctttggaaacacaatttatgcaacagatgtccagatatgattctatttatggaaaaaagtttatatgtgttttacaaatggttttaccatcttatattaaaatgaccttttgacaggtgtgcactgttttgtctccagtgagcacataccatgcggattttatatgtacatcagtagtgtgaatccactggcacagtgtgtgtaaatgccagatgtggtgagattttatcttataaatgtgatcagataaaataactcctgacagaaactgtaaggaaaccagctgaatgtttgacctgatgactgatgttgtatggtttatgttaaatgtatattcttttaatcaatgaataaagcattaaaaatgatcattgtaatatattttattgtatatgaagcatgactacttttagtgttaaataaactgcaataatcctta

SEQ ID NO: 316605 - DNA, 324 bp, Homo sapiens
tacagtgttgtcttttgtttatttttcaggttacacggtgtgggcacacaacctcattgccattgctcgtcttcggggctctgatctgaaagtgcttgaagtcaccgaagaaagcattgattttgaccaaggtgaactggccgaccaggatgtagatccagtgcataaccttattgagcaggtatccctgggcctgggtcaaccttggcatgcagtcatggacatcgaatcactcagtgtcttcactgaaccaaatcgtcatttttacagagagatgcaaagcttcagtgaagacatttagcttttttttaatgtagaattcct

SEQ ID NO: 316606 - DNA, 1369 bp, Homo sapiens
cgctcccctcttccggaagtcgcgccggtgcgcgccggactcctcccaccagcggcgacgtcaaactcagctcctaccacttctctgtctctgccgaccggcgcagggagggctgccttttccttacagtacgccttgaggcttccgggccgctgaagtttacgagcgagggcagtgcagttactcagtgtgccggcctcggacgcacgtgagtagagtttgagaagacagaggctggctcccggcaggccacgcccgcagaggcctttccccctctccacaacttgtgttctacttggttccgccgagacccacgacggttccgcccccttcttcctagtcattgatgttgttgttcttgtcagtgccgcagccccgaccgccgggagctcgaacccgagccggggccgcccgggtggcgcggtggcggcggctgcggctgcagcagctgcgacggctgcgggggctgctccgggtactgcgggggcggccgggagccggcagccggcggcggggccggatggctctgtgcgggcaggcggcgggcgctgcgtcgctgcccagcgagctgatcgtgcacatcttctcttttctgccggcgcccgaccggctgcgggcctcgggcctcctgctcgcactggcgtgagtgcctcttctatccggccctgtggccccagctccgcatctgcctccgcgtctcgcccgcggagcagcctcggctggaattcctcatgcgcaagtgcggctggttcgtgcgagagctgcgtgttgaattcgccgccgagaactatctgagcggcggtgggcccaggggacggaggtggcgcggacaccgggactggaggggaggaagtcgaggccctgcagctctcagctcgttggctggaagtgctgcgcacctacttggagctggtgctttgcgtgctggtcagcatccggaacaacaggaaccttcagaagtttagtctttttggagacataagtgttctacaacagcaaggaagtttgtcaaatacatacctcagcaaggtggaccctgatggcaaaaaaattaaacaaattcagcaactgtttgaagaaatcctgagtaatagtaggcaactgaaatggctgtcctgtgggtttatgctggaaatagtaaccccaacatcactgtcatctctctctaatgctgttgccaacaccatggagcacctcagtttactggacaataatattcctggtaacagcactcttattactgcagttgaactggagcgatttgtgaatctgcactcacttgccttggatttttgtgactttacagctgagatggcaagagtcttaactgatagcaaccatgtgcctttgcaacgactgtctcttctgg

SEQ ID NO: 316607 - DNA, 3055 bp, Homo sapiens
cgctcccctcttccggaagtcgcgccggtgcgcgccggactcctcccaccagcggcgacgtcaaactcagctcctaccacttctctgtctctgccgaccggcgcagggagggctgccttttccttacagtacgccttgaggcttccgggccgctgaagtttacgagcgagggcagtgcagttactcagtgtgccggcctcggacgcacgtgagtagagtttgagaagacagaggctggctcccggcaggccacgcccgcagaggcctttccccctctccacaacttgtgttctacttggttccgccgagacccacgacggttccgcccccttcttcctagtcattgatgttgttgttcttgtcagtgccgcagccccgaccgccgggagctcgaacccgagccggggccgcccgggtggcgcggtggcggcggctgcggctgcagcagctgcgacggctgcgggggctgctccgggtactgcgggggcggccgggagccggcagccggcggcggggccggatggctctgtgcgggcaggcggcgggcgctgcgtcgctgcccagcgagctgatcgtgcacatcttctcttttctgccggcgcccgaccggctgcgggcctcgggcctcctgctcgcactggcgtgagtgcctcttctatccggccctgtggccccagctccgcatctgcctccgcgtctcgcccgcggagcagcctcggctggaattcctcatgcgcaagtgcggctggttcgtgcgagagctgcgtgttgaattcgccgccgagaactatctgagcggcggtgggcccaggggacggaggtggcgcggacaccgggactggaggggaggaagtcgaggccctgcagctctcagctcgttggctggaagtgctgcgcacctacttggagctggtgctttgcgtgctggtcagcatccggaacaacaggttacacggtgtgggcacacaacctcattgccattgctcgtcttcggggctctgatctgaaagtgcttgaagtcaccgaagaaagcattgattttgaccaaggtgaactggccgaccaggatgtagatccagtgcataaccttattgagcaggtatccctgggcctgggtcaaccttggcatgcagtcatggacatcgaatcactcagtgtcttcactgaaccaaatcgtcatttttacagagagatgcaaagcttcagtgaagacatttagcttttttttaatgtagaattcctgtggttacatatgcaagtagggtcctattatgtttttttttcagtagtgtgaattaatccttttgtgctgtgtttaatcagtattagctttatagaattatatatgtatattctacttcttgatcaaagaacgtagtcgggtattggtttagaagttcaaagtgacaatgtatagggctttcacggttaatggacttgttaccaaaccttaaggatatacagccgaagattgtctgaggttgctggctaactttatttttcactgagttactctgcctttttgacgtttttattctttgtgtgtcagagttcagagctcaggagccaaaatatttttatacatatatagatatatatccatagcctggtagatttatatgcaatgcactgcatccatgcattctgatagcatttcattaattttgatttcaaatggaagataaataatatcccaaatgaattatctgtaacagaaaagccaagactttaactttcattacatatctaatagttgatatcaccagttaccattttgaattttgtatagtactaggttagaacattgcttaatccttttaaaaaaaatgcatttacgtaaacacgaatactgaaattgttggattttttaactatatctgacataattttattcatcaattacattacacattcatttagcccagatttcaaatagtgggggaagaaagaaactgtatttcagagtaaaatctcctaaaggaaataaaaacacagagttgtaaatacacatgcttgcaaaaacattagtcgtgaaatccctagcaacaagtcactggatttttctctgtcagcacgcgtgtcagctgccaaagaatagacttaatgaagaagtgcccacatgctggcaggggccggcccactctggccagccagatactgctagattgtaatatttaaggtcgaatttcgacctgtggtacacagctgtgctgtggctcagtcagcaacctcagaactctgaaaaaacaaaacaaaaaaaaaaaaaaaagaaaaaaaaaaaaaacatgcacctgtttcactgtgaatagtgaatgtaaaggaaagaaaggaaaaactgaaagcttgttctatcacaggtatgagctgctatgatacatgaagaacattccatgaagtatgttttaaaaccttgttatatctgagaggctttaaaagcctattaactgtttcagggcaaccgcggtacagacgtggtctctgtgagacttccacctgaccccagttttaagtggtacgaatgttgtgcatttaatgttaaaggacagtctgcaataataaagtaagtagccaacctgggtgcccagcagtgctgagacctggctgctctattgtaagctttggaaacacaatttatgcaacagatgtccagatatgattctatttatggaaaaaagtttatatgtgttttacaaatggttttaccatcttatattaaaatgaccttttgacaggtgtgcactgttttgtctccagtgagcacataccatgcggattttatatgtacatcagtagtgtgaatccactggcacagtgtgtgtaaatgccagatgtggtgagattttatcttataaatgtgatcagataaaataactcctgacagaaactgtaaggaaaccagctgaatgtttgacctgatgactgatgttgtatggtttatgttaaatgtatattcttttaatcaatgaataaagcattaaaaatgatcattgtaatatattttattgtatatgaagcatgactacttttagtgttaaataaactgcaataatcctta

SEQ ID NO: 316608 - DNA, 2321 bp, Homo sapiens
agaggattcattttgatagctatatcacttgtgtttcaggggctattgttgatcttatatccaggcaatatgacaagttcctcactcattttattttaatgaatgatgtgattgacacatctggttttccagatcttagtgacaaccgaaatgaagatccgttggttttattagcatggaggtgcacaaagctctctcttctggcaattcatggttacacggtgtgggcacacaacctcattgccattgctcgtcttcggggctctgatctgaaagtgcttgaagtcaccgaagaaagcattgattttgaccaaggtgaactggccgaccaggatgtagatccagtgcataaccttattgagcaggtatccctgggcctgggtcaaccttggcatgcagtcatggacatcgaatcactcagtgtcttcactgaaccaaatcgtcatttttacagagagatgcaaagcttcagtgaagacatttagcttttttttaatgtagaattcctgtggttacatatgcaagtagggtcctattatgtttttttttcagtagtgtgaattaatccttttgtgctgtgtttaatcagtattagctttatagaattatatatgtatattctacttcttgatcaaagaacgtagtcgggtattggtttagaagttcaaagtgacaatgtatagggctttcacggttaatggacttgttaccaaaccttaaggatatacagccgaagattgtctgaggttgctggctaactttatttttcactgagttactctgcctttttgacgtttttattctttgtgtgtcagagttcagagctcaggagccaaaatatttttatacatatatagatatatatccatagcctggtagatttatatgcaatgcactgcatccatgcattctgatagcatttcattaattttgatttcaaatggaagataaataatatcccaaatgaattatctgtaacagaaaagccaagactttaactttcattacatatctaatagttgatatcaccagttaccattttgaattttgtatagtactaggttagaacattgcttaatccttttaaaaaaaatgcatttacgtaaacacgaatactgaaattgttggattttttaactatatctgacataattttattcatcaattacattacacattcatttagcccagatttcaaatagtgggggaagaaagaaactgtatttcagagtaaaatctcctaaaggaaataaaaacacagagttgtaaatacacatgcttgcaaaaacattagtcgtgaaatccctagcaacaagtcactggatttttctctgtcagcacgcgtgtcagctgccaaagaatagacttaatgaagaagtgcccacatgctggcaggggccggcccactctggccagccagatactgctagattgtaatatttaaggtcgaatttcgacctgtggtacacagctgtgctgtggctcagtcagcaacctcagaactctgaaaaaacaaaacaaaaaaaaaaaaaaaagaaaaaaaaaaaaaacatgcacctgtttcactgtgaatagtgaatgtaaaggaaagaaaggaaaaactgaaagcttgttctatcacaggtatgagctgctatgatacatgaagaacattccatgaagtatgttttaaaaccttgttatatctgagaggctttaaaagcctattaactgtttcagggcaaccgcggtacagacgtggtctctgtgagacttccacctgaccccagttttaagtggtacgaatgttgtgcatttaatgttaaaggacagtctgcaataataaagtaagtagccaacctgggtgcccagcagtgctgagacctggctgctctattgtaagctttggaaacacaatttatgcaacagatgtccagatatgattctatttatggaaaaaagtttatatgtgttttacaaatggttttaccatcttatattaaaatgaccttttgacaggtgtgcactgttttgtctccagtgagcacataccatgcggattttatatgtacatcagtagtgtgaatccactggcacagtgtgtgtaaatgccagatgtggtgagattttatcttataaatgtgatcagataaaataactcctgacagaaactgtaaggaaaccagctgaatgtttgacctgatgactgatgttgtatggtttatgttaaatgtatattcttttaatcaatgaataaagcattaaaaatgatcattgtaatatattttattgtatatgaagcatgactacttttagtgttaaataaactgcaataatcctta

SEQ ID NO: 316609 - DNA, 2382 bp, Homo sapiens
cgctcccctcttccggaagtcgcgccggtgcgcgccggactcctcccaccagcggcgacgtcaaactcagctcctaccacttctctgtctctgccgaccggcgcagggagggctgccttttccttacagtacgccttgaggcttccgggccgctgaagtttacgagcgagggcagtgcagttactcagtgtgccggcctcggacgcacgtgagtagagtttgagaagacagaggctggctcccggcaggccacgcccgcagaggcctttccccctctccacaacttgtgttctacttggttccgccgagacccacgacggttccgcccccttcttcctagtcattgatgttgttgttcttgtcagtgccgcagccccgaccgccgggagctcgaacccgagccggggccgcccgggtggcgcggtggcggcggctgcggctgcagcagctgcgacggctgcgggggctgctccgggtactgcgggggcggccgggagccggcagccggcggcggggccggatggctctgtgcgggcaggcggcgggcgctgcgtcgctgcccagcgagctgatcgtgcacatcttctcttttctgccggcgcccgaccggctgcgggcctcgggcctcctgctcgcactggcgtgagtgcctcttctatccggccctgtggccccagctccgcatctgcctccgcgtctcgcccgcggagcagcctcggctggaattcctcatgcgcaagtgcggctggttcgtgcgagagctgcgtgttgaattcgccgccgagaactatctgagcggcggtgggcccaggggacggaggtggcgcggacaccgggactggaggggaggaagtcgaggccctgcagctctcagctcgttggctggaagtgctgcgcacctacttggagctggtgctttgcgtgctggtcagcatccggaacaacaggttacacggtgtgggcacacaacctcattgccattgctcgtcttcggggctctgatctgaaagtgcttgaagtcaccgaagaaagcattgattttgaccaaggtgaactggccgaccaggatgtagatccagtgcataaccttattgagcaggtatccctgggcctgggtcaaccttggcatgcagtcatggacatcgaatcactcagtgtcttcactgaaccaaatcgtcatttttacagagagatgcaaagcttcagtgaagacatttagcttttttttaatgtagaattcctgtggttacatatgcaagtagggtcctattatgtttttttttcagtagtgtgaattaatccttttgtgctgtgtttaatcagtattagctttatagaattatatatgtatattctacttcttgatcaaagaacgtagtcgggtattggtttagaagttcaaagtgacaatgtatagggctttcacggttaatggacttgttaccaaaccttaaggatatacagccgaagattgtctgaggttgctggctaactttatttttcactgagttactctgcctttttgacgtttttattctttgtgtgtcagagttcagagctcaggagccaaaatatttttatacatatatagatatatatccatagcctggtagatttatatgcaatgcactgcatccatgcattctgatagcatttcattaattttgatttcaaatggaagataaataatatcccaaatgaattatctgtaacagaaaagccaagactttaactttcattacatatctaatagttgatatcaccagttaccattttgaattttgtatagtactaggttagaacattgcttaatccttttaaaaaaaatgcatttacgtaaacacgaatactgaaattgttggattttttaactatatctgacataattttattcatcaattacattacacattcatttagcccagatttcaaatagtgggggaagaaagaaactgtatttcagagtaaaatctcctaaaggaaataaaaacacagagttgtaaatacacatgcttgcaaaaacattagtcgtgaaatccctagcaacaagtcactggatttttctctgtcagcacgcgtgtcagctgccaaagaatagacttaatgaagaagtgcccacatgctggcaggggccggcccactctggccagccagatactgctagattgtaatatttaaggtcgaatttcgacctgtggtacacagctgtgctgtggctcagtcagcaacctcagaactctgaaaaaacaaaacaaaaaaaaaaaaaaaagaaaaaatatgtgcccctgtgtttctcatgggtgaacttaggtcagggttaagggaaaaaaagagaataatacattgaatgctggttccatactcacagagtgttttgaacct

SEQ ID NO: 316610 - DNA, 3278 bp, Homo sapiens
  misc_feature (2)..(2): n is a, c, g, or t
anttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaataaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagtttggcaaactgtggcccccccactgtcatattttgttaataaaattttattggaacacaaccaca

SEQ ID NO: 316611 - DNA, 453 bp, Homo sapiens
tagtgcaatctcagctcactgcaacactgtttcctgggttcaagtgattctcctgcctcagccgcccgagtagctaggatgacagttacccgccaccatgtcccgctaatttttttggatttttagtagagacggggtttcaccacgttggtcaggctggtctcaaactcctgacctcaagtgatccacccgccttggcttcccaaagtgctaggattacaggcgtgagccatggtgcccggccttaccttgacatctttacctaggatttgacttttaaaaaaatcagtgaaaaaaagaattttttttttaacttttagtcctgctgtgtttcttattctccactttcgttatgtagcttgtttgggatagtcagatggaacagggtatcaggtggcacatgtaagtttgttttcaactgaaatgtttgacagcctattcctttcatgatgt

SEQ ID NO: 316612 - DNA, 4674 bp, Homo sapiens
  misc_feature (2)..(2): n is a, c, g, or t
anttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccaca

SEQ ID NO: 316613 - DNA, 4567 bp, Homo sapiens
ttctaacactcaaaggtgaaaggaaatgggttcttttttgatgtgacatgcagaatagttacatgtaacattgatactactgtatgtttattttttaaaatagctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccaca

SEQ ID NO: 316614 - DNA, 4473 bp, Homo sapiens
ttctaacactcaaaggtgaaaggaaatgggttcttttttgatgtgacatgcagaatagttacatgtaacattgatactactgtatgtttattttttaaaatagctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccaca

SEQ ID NO: 316615 - DNA, 4611 bp, Homo sapiens
  misc_feature (2)..(2): n is a, c, g, or t
anttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccaca

SEQ ID NO: 316616 - DNA, 4248 bp, Homo sapiens
  misc_feature (2)..(2): n is a, c, g, or t
anttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtg

SEQ ID NO: 316617 - DNA, 4620 bp, Homo sapiens
  misc_feature (2)..(2): n is a, c, g, or t
anttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccaca

SEQ ID NO: 316618 - DNA, 2680 bp, Homo sapiens
  misc_feature (2)..(2): n is a, c, g, or t
  misc_feature (2642)..(2642): n is a, c, g, or t
anttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagattttttgagactccgaaaagctttgtattttctactactatgctcagtgaacatatactgttgtcacaaattgttctttttattttatctcaaggtgctttggattgcagttagttgagatagcattttctccatcaagaaacttgtgtttattnggttttaaaaatgaaagtgttatggcaatgtcttatct

SEQ ID NO: 316619 - DNA, 830 bp, Homo sapiens
  misc_feature (2)..(2): n is a, c, g, or t
anttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggtaagggctgtttggtatgaccaggtcacggtgggcagcaagcttaatttaagatgggccta

SEQ ID NO: 316620 - DNA, 130 bp, Homo sapiens
gatcttttcagctctgccaagtcccagcctttggtaccagccttttgttctcaatactgggttgtgtgggaaagattctgggaaaggaaactaacgtccagttagatcattaaggaaaatcctaggagag

SEQ ID NO: 316621 - DNA, 448 bp, Homo sapiens
cgttatgtagcttgtttgggatagtcagatggaacagggtatcaggtggcacatgtaagtttgttttcaactgaaatgtttgacagcctattcctttcatgatgtacaggatctatacattgatcgtcctttaccatatctcattgggtcaaagctgttcatggaacaagaagatgtaggtcttggagagctgtccagtgaaggtacttttcttcaccaaataattttgttccttaacatttcttttttattttaaaataatttcaaattttacattaaagtttcaagaatagttcaaagaactctcatatacccttcacctgggtttaccagttaacatttcaccacatttgttagattgttctctacatatacgtaatattttgtcttgagcctatttgggagacatcatgctcatgccctgttacttctaaatgtttctctgtgt

SEQ ID NO: 316622 - DNA, 390 bp, Homo sapiens
cacatgcagctatgctttctcctggttttttgaattctttgtcatataccttatttcaaccagagtgacctcttcacggaagccccccaggatcggcaagctggagcctctgttaaggagggtaagctggggctgggcagctgcgtctccgtgtgcagagttccaaaactgtctttctcactaggagatggaacaaggttgttcccaagccttgtttctgtgttaagcaggaagctgttgtttttactgtggtccagttgaaagtaattcatcttcactaattcatgtcttggaaaaaacagtaccatctgtaaacccataccacagtcttgcctctttgttaggagagaactcatagaaagtcaaacaagaaaagtaccctagagcaat

SEQ ID NO: 316623 - DNA, 337 bp, Homo sapiens
tgtcctacacacgcacatacatacacttttgtagctgaagaaattgtgctccaagagaaacctgtgtgtgatcataaaatttaatgagtaacaaacacagaaccagaatctaagaggcttgagttctaggttagtgttttagggtactccatgctgttaccagagctgggtctttggtggtttgcttgcatgtgtcttaaaagtacctttctccacccctcttcagcaaccgttcttcttttttctttctaaagatgacatcttctcctctggtatccaggctaagacaaccaaaccaaaaagccgatctgcacaggccgcacctgaaccaagattt

SEQ ID NO: 316624 - DNA, 4580 bp, Homo sapiens
  misc_feature (2)..(2): n is a, c, g, or t
anttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccaca

SEQ ID NO: 316625 - DNA, 3484 bp, Homo sapiens
ctgcggtgactctagacgatcccgtatcgcttagtgctccccggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccaca

SEQ ID NO: 316626 - DNA, 4311 bp, Homo sapiens
  misc_feature (2)..(2): n is a, c, g, or t
anttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaagggccgcgatcctgatgcccaccccaagagcacaggtgtcttccaggatgaagagctgcttttcagccacaagctccaaaaggacaatgacccagatgttgacctttttgctggcaccaaaaaaaccaagctgttagagccaagtgttgggagcctgtttggggatgatgaagatgatgatcttttcagctctgccaagtcccagcctttggtacaagagaaaaagagagtagtgaaaaaagaccactctgttgactctttcaaaaaccagaaacatcctgaatccattcaaggtagtaaagaaaaaggcatatggaagccggaaacacctcaggactcatcaggtctcgctccatttaaaaccaaagaaccatccactcggatcgggaagatacaagcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtg

SEQ ID NO: 316627 - DNA, 3111 bp, Homo sapiens
  misc_feature (2)..(2): n is a, c, g, or t
anttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaaccttaccctcaggagaagcaaaacctcggaagacactcaaagagaagaaggaaaggagaactccttcagacgatgaagaggataacttattcgcaccccccaagctgaccgacgaggacttctcgccatttggctctggaggtggcctgttcagtgggggcaaggggctctttgatgatgaggacgaggagagtgacctcttcacggaagccccccaggatcggcaagctggagcctctgttaaggaggagtcttcatcatccaaacctggaaagaaaatcccagcaggagctgtttctgtatttttaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggcaaagtccaatccactgccgatatctttggtgacgaagaaggagatctgttcaaagaaaaagccgtagcatcgccagaagccactgtgagtcagacagatgaaaataaagcaagagcagaaaaaaaggttaccttatcttccagcaaaaatctcaagccctcatcagaaacaaagactcaaaaaggcttattttcagatgaggaggactctgaggatttgttttcttctcaaagtgcgagtaagttaaaaggtgcgtctctgctgcctggcaagctccccacgttggtttccctgtttgatgatgaagatgaagaggataatctttttgggggtacagctgctaagaagcagacattgtgtctacaagctcagagagaagagaaagcaaaagcctccgagctctccaaaaagaaagcatctgccctgttgttcagcagtgatgaggaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacagccaaaagaagacccagagagtgtcactcctctttgaagacgatgttgatagcggaggctctctgtttggctctcctcccacatctgttcctcctgcaacaaagaaaaaagagactgtctctgaggcaccacctttgctgttcagcgatgaagaagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccaca

SEQ ID NO: 316628 - DNA, 1041 bp, Homo sapiens
  misc_feature (2)..(2): n is a, c, g, or t
anttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatcgtgtatatgatgaagaagtggaggagccagtactcaaggctgaggcagaaaaaacagagcaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggatctatacattgatcgtcctttaccatatctcattgggtcaaagctgttcatggaacaagaagatgtaggtcttggagagctgtccagtgaagaaggctctgtaggcagtgatcgtggcagtattgtggacactgaggaagagaaagaagaggaggagtcagatgaagattttgcccatcatagtgacaatgaacaaaaccggcacaccacacaaatgagtgatgaggaagaggatgatgatggctgtgaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaagtgagccccagccgcgttgatgggga

SEQ ID NO: 316629 - DNA, 411 bp, Homo sapiens
  misc_feature (2)..(2): n is a, c, g, or t
anttggctggggctaggcttccggggctctgcagtcctcggcgtgtgctggcagcttcggagcccaccgagccgggcggctaggatgatgaaccggacgacccccgaccaggagctggcgccagcgtcggagcccgtgtgggagcggccgtggtcggtggaggagatccgcaggagcagccagagctggtcgctggcggccgacgcgggcgtgagaggcgggccccggggacgcgagagcggcaggggtgacgcttggcttgcgcgcaggagggccggaccgcgactgcccctgcacctggcccgtcccgttgcctgccctcttaggaacacacgccccgtttagcccccgagaatgccaccctggcagtccccggccaccagggagaggggcagacactgaccgtggccc

SEQ ID NO: 316630 - DNA, 3162 bp, Homo sapiens
aaggctaggtacgaggcctgggtggtaccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaa

SEQ ID NO: 316631 - DNA, 3252 bp, Homo sapiens
tcctggctgcccgcacctgcacccgcgcgtcggcggcgccgaagccccgctccccgcctgcgcgtctgtctcgtccgcatctccgcggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaa

SEQ ID NO: 316632 - DNA, 2978 bp, Homo sapiens
aaggctaggtacgaggcctgggtggtaccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattcca

SEQ ID NO: 316633 - DNA, 3196 bp, Homo sapiens
agcggacggagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacattgcgtacttgaaggaccgaaggctgagtggaggagcagtgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaa

SEQ ID NO: 316634 - DNA, 1090 bp, Homo sapiens
gggaaaatgcctgacagcagacacaagggaaccctgctgggttctggggccccactggccatcccgacatgctgaaccaattcagacccttcctcctggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagcgcgagaaaactcgggcccttaaccgtgctcggaacggggccaatggccagaactccgaggtcccggaaaagaggggaaggggacaagtggccaccttagaagagagaaggggagacaaaccaaaggagcccgcaaaaacacttcaaaggacgaaaccctaggagacccacaagagacacaacgcacagcaacgcgaagagacacacacaaacatgcacgggggtaatacacaaaacccaaagagaaaacgccagaacacggaacgctacagacgagcacagacgaggggtacaagccgacaatcctacacaaacagacgaagagaaaacacacacagcgctaaacacagcaacaactaacacccgcagcgcgcagatacaagccgcagcaag

SEQ ID NO: 316635 - DNA, 383 bp, Homo sapiens
agaagaaaataataaacattaaaagttcaccttgaccaaagagacaacctccagaagaacaccacatatgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtgtgtgtgtgtgtgtgtacctcggccgcgaccacgctaa

SEQ ID NO: 316636 - DNA, 390 bp, Homo sapiens
caggagagttccggagggtagagtttgctgcccgcaagtcttgcttgtgaaactctgaattagggaattagggcacagtctgaattgagggcagtatgcgaccaccgctccgcgtcctcctttacagaaacagtcctacttctccactggcatcctcttgagggaggcacagctggaaacccagcacctccctgcaccagctcagggctgcctggtcagctgctggccgcagccccctaggcccactcactgtcgccggccctgcatgcccccagcccgacagctgtcgccagcctcctgactcaggaggagccctttgtgccttcgaggaacggttcgctggccgctttgcttgcagcctacttttcccaccagaggcacctggccctg

SEQ ID NO: 316637 - DNA, 3320 bp, Homo sapiens
agcgggcttcgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaa

SEQ ID NO: 316638 - DNA, 2973 bp, Homo sapiens
agcggacggagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattcca

SEQ ID NO: 316639 - DNA, 3160 bp, Homo sapiens
tcctggctgcccgcacctgcacccgcgcgtcggcggcgccgaagccccgctccccgcctgcgcgtctgtctcgtccgcatctccgcggcctcctgctccacgacgtgaccatggccgggctgcaggagctgcgattccctgaggagaagccgctgctccggggccaggacgccaccgagctggagagctccgatgccttcctcttggctgcagacacagactggaaggcctaacaggtaccaggctgcgtcacctcattccccagaggagccaagagcggaggctgcccagagtgtccagcacggtctctccccttcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattcca

SEQ ID NO: 316640 - DNA, 3070 bp, Homo sapiens
aaggctaggtacgaggcctgggtggtaccactcgagctgcccccgccctctggacccgagtgactcaggcctttgtttgtccttcctggtagaggcgggttccctccctcggcaagatgccggagtgctgggatggggcctaacaggtaccaggctgcgtcacctcattccccagaggagccaagagcggaggctgcccagagtgtccagcacggtctctccccttcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattcca

SEQ ID NO: 316641 - DNA, 3122 bp, Homo sapiens
tcctggctgcccgcacctgcacccgcgcgtcggcggcgccgaagccccgctccccgcctgcgcgtctgtctcgtccgcatctccgcggcctcctgctccacgacgtgaccatggccgggctgcaggagctgcgattccctgaggagaagccgctgctccggggccaggacgccaccgagctggagagctccgatgccttcctcttggctgcagacacagactggaagaggagccaagagcggaggctgcccagagtgtccagcacggtctctccccttcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattcca

SEQ ID NO: 316642 - DNA, 3068 bp, Homo sapiens
aaggctaggtacgaggcctgggtggtaccactcgagctgcccccgccctctggacccgagtgactcaggcctttgtttgtccttcctggtagaggcgggttccctccctcggcaagatgccggagtgctgggatggggtgggggaaggcaacgctggagccgtgaagctggcagggctaggggaccccaggtggagcccagggcacctcctctcgccggggcatcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattcca

SEQ ID NO: 316643 - DNA, 3012 bp, Homo sapiens
agcggacggagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacattgcgtacttgaaggaccgaaggctgagtggaggagcagtgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattcca

SEQ ID NO: 316644 - DNA, 2919 bp, Homo sapiens
agcggacggagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattcca

SEQ ID NO: 316645 - DNA, 2793 bp, Homo sapiens
agcggacggagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattaaaaaatattatctgaaaataagtaaaatctcgagtttttttttttgcctttttgcattataccgtttattgc

SEQ ID NO: 316646 - DNA, 2967 bp, Homo sapiens
  misc_feature (2755)..(2755): n is a, c, g, or t
agcggacggagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtttntacttatataccatacattgctccatttttactatcgttctaaaatttccttttattcaaatttacctttaatattattactttctgtctccgaccaattaatatccctacttttgtcttcccatactactttcttaaaatattacatttaatcacatctttatcacccttaaataattcccttctttaaacttatcaactccctttaataa

SEQ ID NO: 316647 - DNA, 2767 bp, Homo sapiens
agcggacggagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcggagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggtcattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgctcactccttggcgacgtggtttttcctctgccccagaccagtctagcaagacttgactagcatcgatattattgagatctctgtctggtctgtgctgtgcgacac

SEQ ID NO: 316648 - DNA, 318 bp, Homo sapiens
ttgcgaggtgaacggaagaacattgtcaggcgctgagacgcgttctcagggtcctggggagaaactccaccaggcagccccaagctgggaagggcacagagcgggcaggcctcccccattctgtatgcaggagactgaggcctagcagaatggtgaggggataagcaccccacctgtcagggcttccttgggccagagatccttctgggggccactgctgggtgggcaggcaggagtgggcttccagaagcctctggccctgcccccagcctctctgtgcctgtcctttgtcccatctctctggctcatctcaatgcc

SEQ ID NO: 316649 - DNA, 630 bp, Homo sapiens
cctctctgtgcctgtcctttgtcccatctctctggctcatctcaatgcccttgactcagcggaccacgctcttcactgtgttgtgtctcccccatccccgccccctctccggctctgtcttctctcttagttgcgtacttgaaggaccgaaggctgagtggaggagcaggtagccccacggcccttcccctgatgcatggacgcccagcctcctcctcccccgctccttcctctgcgcagtgtgctgcagccaggccgcatcttgctgtggtttggaaccttcttgtgtcctgttcaactcagaaaccccacagattcttgcttttctgcagacttggcctctaggttggctgggttgcagagcagtcttgcttctaggttgtcatgagctgcgtggcttccagagctctggggataggaaacagaccctccttagaggtagagcccaggcctggccctgcctgagccacataggtggccaggagagttccggagggtagagtttgctgcccgcaagtcttgcttgtgaaactctgaattagggaattagggcacagtctgaattgagggcagtatgcgaccaccgctccgcgtcctcctttacagaaacagtcctacttctccactggc

SEQ ID NO: 316650 - DNA, 1204 bp, Homo sapiens
tagctggtacccgccatacagatcaggtgaactggcctatgcggtcgaggagtggcctggtttctggcagggccccgacagacactcgttgacatcggtctcacagcgaggtccagtgtagccacgaccgcactggcacagtgaaggagccctgcgtgttcacgcacctgcccaagtgctcgcaggggttggcgccgatagagcactcgtccacgtcctggtcacatgccccaagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagggtaagcacatgtcttggctgtgctgaccaggccttgatagttcatttagtcttaatctttcctcatgcatagacattttccttccctgttcttcaaatcttattatcttatttgtagataattggctgatactcagttaaatttgaatttcagatcaatagtgaatacttttttagtatacttctagtgtatctcagatacgacttgctaagacacactaaaaaattcttcttaaaaaaaaactcagatttatcctttcttgttttttgttgtttttggttttgttgtttgctaaatttggcaacctgcaggtctctgtcttgtgcctctcttgacatccttgcccagtgctttaggtaaacatctttgtctcacctcagtagtgagacataaactttatttttctgacttcctatttcatacgtaacttcaagagttgtgtgtctattgagccaatcttttttttatgtatcagcttattaatctttcaagggttccctttcaacagttaggataagatacagattctttcatatgacttgttgaaaagccttcacattctggctataaactattattccctttttttcccccattgagtcattttgtttgtatacatgtattaacatccctagaaaagaaacccctgaaggatggataccttgagcccaggagtttgagcctgcagtgagctgtgactgctccattatactccagcctgggtgatggagtgagaccctgtctctaaattaaaaaaaaaaaaaaaa

SEQ ID NO: 316651 - DNA, 2237 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316652 - DNA, 1538 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaa

SEQ ID NO: 316653 - DNA, 2278 bp, Homo sapiens
gggcattttaggaggaaaaaaaaaaacaatgcacagaaaaagggtaaaacaaaataggttgatgtggtggagacctttgacctcccaggtgcccccacaagcagctggcccaccctggagcaccaaagttgggggccacagccaccactgcctcttggagtccctttttcatggaaatgaagaccccttggtcgtgggccactagtgtacatgggctggaagtggggatgtccatggcccaagagacccctccagcttccagcccctggcaacagcgggagagcaaacccagcaccagggacttggcgtgagccagccgggaggcccccaatcaggctctggggtatcagagcaaccaagttgacgtagtgtgaaaaaatagtattcctttgataaaaaatactgtcccttggtcttctctaagtttgaaacaccccgaataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagcccgaattcgggcattcttagtgccccctatgaccatctacactgaacaagatttatacagttatgtcatatctaagccccgcaacaaaagagtacccattcttccttttgttataggagcaggagtgctaggtgcactaggtactggcattggcggtatcacaacctctactcagttctactacaaactatctcaagaactaaatggggacatggaacgggtcgcccgactccctggtcaccttgcaagatcaacttaactccctagcagcagtagtccttcaaaatcgaagagctttagacttgctaaccgctgaaagagggggaacctgtttatttttaggggaagaatgctgttattatgttaatcaatccggaatcgtcactgagaaagttaaagaaattcgagatcgaatacaacgtagagcagaggagcttcgaaacactggaccctggggcctcctcagccaatggatgccctggattctccccttcttaggacctctagcagctataatattgctactcctctttggaccctgtatctttaacctccttgttaactttgtctcttccagaatcgaagctgtaaaactacaaatggagcccaagatgcagtccaagactaagatctaccgcagacccctggaccggcctgctagcccacgatctgatgtccc

SEQ ID NO: 316654 - DNA, 1073 bp, Homo sapiens
  misc_feature (918)..(918): n is a, c, g, or t
  misc_feature (920)..(921): n is a, c, g, or t
  misc_feature (929)..(929): n is a, c, g, or t
  misc_feature (936)..(937): n is a, c, g, or t
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggctnannattcctcnctttcannaatctggtcccctcgtgcaagaaccctaagcgtacccttttaagaaagggaccgagttggtatacctcgggtcgggggcctcgctgtggacgggataggggggatgagaggaggttaggcacccgcagcgcctctt

SEQ ID NO: 316655 - DNA, 1024 bp, Homo sapiens
  misc_feature (19)..(19): n is a, c, g, or t
  misc_feature (27)..(27): n is a, c, g, or t
aaacttacggctaggtagnggccggtntgaatcaaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaaaaaatgttacccattttttacataactggcacaaaatgttggtaaaaccagcggcggaggccgggtggcc

SEQ ID NO: 316656 - DNA, 745 bp, Homo sapiens
gacgcgtgggcggacgcgtggaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316657 - DNA, 597 bp, Homo sapiens
ggtagtacccggaatgtgtccgcggtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttacccccccttcaacacaattcccctctcctcttccaaacaaaacatacatagatctctcacatccagctgccaaaagaaaaccccatcaaacacagttacaccccacatatctctcacacacacacacacacgcacacacacacacagaga

SEQ ID NO: 316658 - DNA, 231 bp, Homo sapiens
tccctcaagctgcaagcagcaaccccctcgagactctatgacaccccacatatctctccacacgcacacacacacacacagatctgacgtaatcaaactccagcccttgcccgtgatggctccttggggtctgcctgcccacccacatgagcccgcgagtatggcagcaggacaaggtttgattacgtcagatctgtgttatgtgtgtgtgagagatatgtgggggataac

SEQ ID NO: 316659 - DNA, 2749 bp, Homo sapiens
  misc_feature (2248)..(2248): n is a, c, g, or t
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgataaaaaaaaaancaaaaacacaaaaaaaaaacaaaaacacatgaaaaccgagaaagtcccacacagcgcagaccagacgactaagagggacagcaagcgaagacgcgcacaatcatcctcctccgcacacacggcggtgatgctcataccgtgagcacgacctccaattagatatgtcgatgagctagccatcccggcccggtgccagtacgcccgacggcgccccacacgaacacgagagcgccaaaactagacgaccaacccacacacacgacacaacagcggcgtcagaaaacacatcagcagagaaacaaacgatgccaagcgccagctggacacaacaacaccgacgccgactcgcatccgagcagagagggacagctcaaccgagccggacccccccgacgcccaccacctacgtggcggcagaggcacgcagcaagacgagacacgccgccacacacagacgcaggggggccacacacaccgccgcaccacaaccgaaacacaaac

SEQ ID NO: 316660 - DNA, 2729 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgatacaatgatcatctgcctttgccagagtctttttttccttcttcaagagccttggctcagtagagaccacatgagctaatcatagtcaatgccttatcaagcaagagagccctccataaatgggcacgtgtggtgcttcaaggcagaaaggccctctcatatctggtcctgtagtgcctgtccctagtttttttttgtttgtttttttttccgggggcgggggtgggtgtattttaatcacattgttggaggttgaggaccatggatggagaacgcattgtccctttaggagagcagccagaaactgctggggactctgagccatgcatatcctgtaggtgtaactgtaacctagtcatgtgttatgtgttttatttttagttgacctagttgctaacacttagatgtgtaattctgcatttgtcacaggagaggaagatttggcagcagaggccctgtattccaacatatgtaagcccccacctggaatgga

SEQ ID NO: 316661 - DNA, 2293 bp, Homo sapiens
  misc_feature (2282)..(2282): n is a, c, g, or t
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgatcacgcacatgaaaaacgacgctggtcgacatatcctactcccggncgtaccagcct

SEQ ID NO: 316662 - DNA, 2951 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgataaaaaaaaaaaaaaaaaaaaaaaaaaaattttggggggggcggggctagaaaaaagttttaaaaacccattcgggtggggggcgggggcccaggtgggggtaggagcacatggggccaacccggctcccccaaagaaagccccggcgggcaatgcagactacggcgcggtgggcctctcccaccaataaaaaaaaacgcccggcggcggaacaccccggacggcggttctgtggaccactccccagatgggtgtccggggcccaaaactgggcaccaaccacacgcggagctcccaacaggagacgcccgaggatatcaaattagccccggcccctgagcgtgggagacgcgcaacacacagagccagcacacaaagcggaagaggacaagaacgagaagggcgaaagagcaggggagaccagagaggaagcgaccaacgcgcacagagagggaagaccaggccagcagcaagaagagggcaagagagacgagaagggggcgcgaggagaaaaaggacacggagaacagcggcagagcgcaaacgaagagatacgagagaaaaagcaggccgagagcaaagcacgcagagagacaggcgaccgagaaagaaggaaaggcagagaacaaagaaacgaagcacaaggaaacgaagaaaagacaaagcaggagggcggcgaggcagaagggaccaaagcggagcaagacaggaaagg

SEQ ID NO: 316663 - DNA, 2195 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacctgccgaacaactcactacgttagtctacctg

SEQ ID NO: 316664 - DNA, 2226 bp, Homo sapiens
aaagagagaagaagcacaaataatgactaggtacgagactgggtttacttatgaaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316665 - DNA, 2221 bp, Homo sapiens
cttgagtatcacaaccgtcgcacctccattgggtcgctgactgtggagaaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316666 - DNA, 2206 bp, Homo sapiens
  misc_feature (19)..(19): n is a, c, g, or t
  misc_feature (27)..(27): n is a, c, g, or t
aaacttacggctaggtagnggccggtntgaatcaaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316667 - DNA, 2195 bp, Homo sapiens
ccgggttggaatcggacgagggaaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316668 - DNA, 1832 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaatta

SEQ ID NO: 316669 - DNA, 1907 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgtccccttgaaaagcgtagattttagtggcggtctcactttcaccagcagttcgcccgttagttctcaggatcgcgatgggctggacgtcgtgaggcggacgcgtggg

SEQ ID NO: 316670 - DNA, 2209 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacaacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316671 - DNA, 2186 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316672 - DNA, 2252 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaaaaaaaaaaaaaaaaaaaaaaaaaaaaaattttggggggggcggggctagaaaaaagttttaaaaacccattcgggtggggggcgggggcccaggtgggggtaggagcacatggggccaacccggctcccccaaagaaagccccggcgggcaatgcagactacggcgcggtgggcctctcccaccaataaaaaaaaacgcccggcggcggaacaccccggacggcggttctgtggaccactccccagatgggtgtccggggcccaaaactgggcaccaaccacacgcggagctcccaacaggagacgcccgaggatatcaaattagccccggcccctgagcgtgggagacgcgcaacacacagagccagcacacaaagcggaagaggacaagaacgagaagggcgaaagagcaggggagaccagagaggaagcgaccaacgcgcacagagagggaagaccaggccagcagcaagaagagggcaagagagacgagaagggggcgcgaggagaaaaaggacacggagaacagcggcagagcgcaaacgaagagatacgagagaaaaagcaggccgagagcaaagcacgcagagagacaggcgaccgagaaagaaggaaaggcagagaacaaagaaacgaagcacaaggaaacgaagaaaagacaaagcaggagggcggcgaggcagaagggaccaaagcggagcaagacaggaaagg

SEQ ID NO: 316673 - DNA, 2222 bp, Homo sapiens
ccagatatgtactagctcggtactctggttttaatttcatgaccagggctgtgttgtagttaacgttagcaaggtacggtaggctgacagaatctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316674 - DNA, 2131 bp, Homo sapiens
  misc_feature (122)..(122): n is a, c, g, or t
aagatgccagcttttgatttgttatgagaaacattgtacttgaaagaaagaattgtttcatcgttcaaatactgtaccaatactggtagtttcgctctgaggagcttcttccgatgcacacngtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316675 - DNA, 2157 bp, Homo sapiens
gagactagtgtgttagaggatcagaataagtgtattcgtacaacctatatatcatacaaaccctgtctaagtccctgcaggcaaagacatacgatcttgcgttgggagccctcgcgagcgcccggccggagcccccagcgcagggcgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316676 - DNA, 2256 bp, Homo sapiens
tagctggtacccgccatacagatcaggtgaactggcctatgcggtcgaggagtggcctggtttctggcagggccccgacagacactcgttgacatcggtctcacagcgaggtccagtgtagccacgaccgcactggcacagtgaaggagccctgcgtgttcacgcacctgcccaagtgctcgcaggggttggcgccgatagagcactcgtccacgtcctggtcacatgccccaagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316677 - DNA, 1323 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacaacaagaacaagcaaaacttacaccctttatccccatacacgttattatcgaaaccatcagcctacacatcaaaccaaaagccctggcagacgcctaacgggaacattcctggggccacactatatggcactaatgggaaggcacctagaattgcacatgaacttcctcagatgatattacagagtcattaggaaaccaaaaccgtggcctaccacgcaggtcaactctgtacttagggaagataaaaaaaccgggtatcgggagaggaagggcatcccttgaggacg

SEQ ID NO: 316678 - DNA, 1055 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaaaaaatgttacccattttttacataactggcacaaaatgttggtaaaaccagcggcggaggccgggtggcc

SEQ ID NO: 316679 - DNA, 2084 bp, Homo sapiens
tcacgagtctgactctcgggcggagcgctcggcgacgggccgcgtgcggagggcctcagggcaaggatccagattttgaagtgtgaagagtaggaacggaaagtcttctagctgttttcatgctgtcagtattctaaagtcgtgactaggacaacccctgcggagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316680 - DNA, 1107 bp, Homo sapiens
  misc_feature (1107)..(1107): n is a, c, g, or t
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaaaaattcttggtcttccatccggcaaaaaccctaagggtccctttgggaaaggcgcacgattgttaatcccgcgggggtgggggcccacggttggagcgggctttggtgtttgggagaggacatttgttatgtcgcgcgcgtgttgttgataataataacn

SEQ ID NO: 316681 - DNA, 2304 bp, Homo sapiens
  misc_feature (688)..(688): n is a, c, g, or t
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttggcggaaaaaaaccccgaaaaaaaaaaaaaaaagggggggggggcgaaaaaaaaatttttgacctcgaaaacagacaagtggncacaaagcgggcacaggcctggtgctacagcaaaaacaaacattcaccttaaaaaagtccccgccgtttttttttggaggagccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316682 - DNA, 2096 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316683 - DNA, 1706 bp, Homo sapiens
aggggggggggaaaaaaaactatatcggcaggagcgaggctgggtgatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316684 - DNA, 1977 bp, Homo sapiens
  misc_feature (17)..(17): n is a, c, g, or t
aaacttagtgctaggtncgaggcaaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcaggtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316685 - DNA, 1050 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagacccgaagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggtgtttctaactgggg

SEQ ID NO: 316686 - DNA, 1569 bp, Homo sapiens
atcacgaagcagagagtaatggacagcacagagagccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316687 - DNA, 1889 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316688 - DNA, 1525 bp, Homo sapiens
gagctcggtacccgtaaggcgcgagatatgttcacgcgaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316689 - DNA, 1494 bp, Homo sapiens
ctagcaggatcctagtattgtagaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316690 - DNA, 1474 bp, Homo sapiens
ccggaggatcacttgaaaccaggagtttgagaccatcttgggcaacatagcaaggcctcatctctactaaaaattaaaaattagctaggtgtggtggcatgagcttatagttccagctacttgggaggctgagactggaggattgtgtgagcccaggagttagaggctgcagtgagctgtgatcatgccattgcactccagcctgggcgacagagcaagactgaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316691 - DNA, 985 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcagaaacggaggtggagctgtactggacacatattgatattatttgtatctattccatgtatcactttctcctaaggcatcaaatctaatacaaaaaaagaaaagcaaaacacaaaacctaggctcaaattccaccttggccatgttttagccgagtaactcacgttccccggtgtctaatctttaccagaaacttccttatctttaacatagggaaaaagcc

SEQ ID NO: 316692 - DNA, 875 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggtgggtctcccacagctgaccagcccactctggtgatgcctgaccactgacccagtccctgcctggcctcctgcccttaatcttcttccctaacccactcttttctgtat

SEQ ID NO: 316693 - DNA, 1590 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316694 - DNA, 1196 bp, Homo sapiens
ggcctggagtctgtggcataaagacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316695 - DNA, 1201 bp, Homo sapiens
cttggctgtaggaattcggcactaggacacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316696 - DNA, 1329 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagcttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316697 - DNA, 835 bp, Homo sapiens
aagcagtggtatcaacgcagagggcccattacggccgggttactatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 316698 - DNA, 703 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaggccccaaaaggggaaccgagctcgaat

SEQ ID NO: 316699 - DNA, 1185 bp, Homo sapiens
agcggacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagggtaagcacatgtcttggctgtgctgaccaggccttgatagttcatttagtcttaatctttcctcatgcatagacattttccttccctgttcttcaaatcttattatcttatttgtagataattggctgatactcagttaaatttgaatttcagatcaatagtgaatacttttttagtatacttctagtgtatctcagatacgacttgctaagacacactaaaaaattcttcttaaaaaaaaactcagatttatcctttcttgttttttgttgtttttggttttgttgtttgctaaatttggcaacctgcaggtctctgtcttgtgcctctcttgacatccttgcccagtgctttaggtaaacatctttgtctcacctcagtagtgagacataaactttatttttctgacttcctatttcatacgtaacttcaagagttgtgtgtctattgagccaatcttttttttatgtatcagcttattaatctttcaagggttccctttcaacagttaggataagatacagattctttcatatgacttgttgaaaagccttcacattctggctataaactattattccctttttttcccccattgagtcattttgtttgtatacatgtattaacatccctagaaaagaaacccctgaaggatggataccttgagcccaggagtttgagcctgcagtgagctgtgactgctccattatactccagcctgggtgatggagtgagaccctgtctctaaattaaaaaaaaaaaaaaaa

SEQ ID NO: 316700 - DNA, 713 bp, Homo sapiens
gtaagcagcttttccacatctgccccacatctgtaccctatatttttacccagagagaaaacacaaaacttcaaaagtgtaatgctcggaaggctactggcattgccctttgctgtgagggcagtttcttgtccttcaggtcaggcagattcttttaaatgcttcaagtaattcgtgtcagtttcaggaccctcctatttgacttatacttatggtttttctccaatttcagagtcgggaagacatcactcatgaaccagtatgtgaataagaaattcagcaatcagtacaaagccacaataggagctgactttctgaccaaggaggtgatggtggatgacaggctagtcacaatgcagggtaagcacatgtcttggctgtgctgaccaggccttgatagttcatttagtcttaatctttcctcatgcatagacattttccttccctgttcttcaaatcttattatcttatttgtagataattggctgatactcagttaaatttgaatttcagatcaatagtgaatacttttttagtatacttctagtgtatctcagatacgacttgctaagacacactaaaaaattcttcttaaaaaaaaactcagatttatcctttcttgttttttgttgtttttggttttgttgtttgctaaatttggcaacctgcaggtctctgtcttgtgcctctcttgacatccttgcccagtgctt

SEQ ID NO: 316701 - DNA, 1269 bp, Homo sapiens
ccctgggatactcccctcccagggtgtctggtggcaggcctgtgcctatccctgctgtccccagggtgggccccgggggtcaggagctccagaagggccagctgggcatattctgagattggccatcagcccccatttctgctgcaaacctggtcagagccagtgttccctccatgggacctaaagacagtgccaagtgcctgcaccgtggaccacagccgagccactgggcagccggtgatggtcccacgcaggagcgctgtggaccccgctctctgggcagccctgtcctaggcctggacacctgcagagcctgggaccacgtggatgggcagatcctgggccagctgcggcccctgacagaggaggaagaggaggagggcgccggggccaccttgtccagggggcctgccttccccggcatgggctctgaggagttgcgtctggcctccttctatgactggccgctgactgctgaggtgccacccgagctgctggctgctgccggcttcttccacacaggccatcaggacaaggtgaggtgcttcttctgctatgggggcctgcagagctggaagcgcggggacgacccctggacggagcatgccaagtggttccccagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccagaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagc

SEQ ID NO: 316702 - DNA, 1321 bp, Homo sapiens
ccctgggatactcccctcccagggtgtctggtggcaggcctgtgcctatccctgctgtccccagggtgggccccgggggtcaggagctccagaagggccagctgggcatattctgagattggccatcagcccccatttctgctgcaaacctggtcagagccagtgttccctccatgggacctaaagacagtgccaagtgcctgcaccgtggaccacagccgagccactgggcagccggtgatggtcccacgcaggagcgctgtggaccccgctctctgggcagccctgtcctaggcctggacacctgcagagcctgggaccacgtggatgggcagatcctgggccagctgcggcccctgacagaggaggaagaggaggagggcgccggggccaccttgtccagggggcctgccttccccggcatgggctctgaggagttgcgtctggcctccttctatgactggccgctgactgctgaggtgccacccgagctgctggctgctgccggcttcttccacacaggccatcaggacaaggtgaggtgcttcttctgctatgggggcctgcagagctggaagcgcggggacgacccctggacggagcatgccaagtggttccccagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggaggggtcagtccagccgaggcccagagggcgtggtgggttcttgagcccccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagc

SEQ ID NO: 316703 - DNA, 834 bp, Homo sapiens
tgcctctcccatgggactaccctgaagccccatggaggcgtctccacagcagccctcctcgcccatgcccacgggcactgcagggtggcgggaggagggggcccaaccctgacccccggggatccaagggcttgaagcagacagtgggggccctgaaccccaacctacatctctggggcatctgcagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccagaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagc

SEQ ID NO: 316704 - DNA, 643 bp, Homo sapiens
attgtttatatctgtatttcctctttcattagagaaaaggtagtacatcttattcttcatggtgtctacaatatctggcagtttttggaagtcaagcgtgagcttagagcatagactggtgggattgtcaaagaagagggcaactggaagagaactgtcagttatttttggatcagtctttaattcatcatgacgggttaggcattagttgtatttcttgctaattttgaagaagacttattaacaaatcctacattaggtaaatggttttgaaagttgagttaatcataatggtgtttgacctaggactatttttaggccctatttatcttaatatcgaataatgaagcagcttcccccttagatatagacagaaaacatcaaagccaccacactacctggctggatttatcctagtaataaaatcaaaactgagctagttctctggctttcattgtaataattgtccttgtggttgtaaggaatctagatgaaaattacatggtctgttctacagccacagctgtacctacattcagaagacagacaaaagttgctgtgtttgaagagatccttcattaagggatcagacagagattactttgagacatattctaagtttaacttttctgcagggttgcca

SEQ ID NO: 316705 - DNA, 1850 bp, Homo sapiens
gcgcagtccagatgtcgtcagcaccagcgcctgggctggaggacagagaagccttttccgttgccggtgccggcctagcgtcctggaattacttcaatcaaaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggtttgtgctttgtttaactacctatgtgggcatcctaagatgaccatctacctcagtagatgtagagtgagcattagtagcatgttaaatctaagctattaacatttttaaacccttgttatactgcagtccgtaatttttgcttgcagattttttttaattctaaaaattagaaattaggtctgttattataaggtatttaccttttgttttcttttaaaacatttttaagttgtttaaaaccatgtcccttattgtaactccctgagatacatctacttagttaatttaatgttaagttttatgaaaaagccctgaaggtaaatgattcactccatgtatgcttacagagccttcaaataaatgcatgatgttatttctgttttaaataaatgagtaggttgattttattttcttaaagcttcctcacattgataatctggaaaaaaaaaaaacacattgaatttcagtataccaagggttgcagtgattttggttttcgtgaaagttcaagatttcctgtagcttaggtgccaaatgggcactgggtgttttattttatgccagattttcttgttcattcttgctatatttctagaatatctctaaataataaattcttctctctgttatttgtgtgtgtgatttttatagtggagaaggcaaatgcaaaacccttccagatgcctgaaaaacagtgggtcctctgcagctacaggggattctagacattaactaaaggccagcaagcactcaagtgccccaagtgttttcctggtgtaaccatttgttaactacattttctctctttttacattttaggctgttaaagtaatttgacagaaaaaaatgagcaggttttttggatctaaaaagccactgtgacaagaaattttaataccattttgtaaaattttctaaggcgtattttataattagtttgttcccaatgtactgctacttgatttgcattttggtaactataaattttactcgaatcactgaaatatgataaaactgctggattttaagttaataatttaatatgctgaccaggatttaaatgctttcccctttccttaataaactggtcagtggaagtggaatcttaatattgttcattttagatgctatctgaaatctttgaaaacaaatgtgagcatttacaccataccttgtaaaagttgtgaaatgtctagtccttaacagagaagttgcctctggttttctaaagaaattaacttatatttataaatgggttaagacatgttatgtaatagtacctctgtctccatgatattaaagtgtatgagcccagttttaaggttttgtaatgtatagatagataaatttttgagttagtgtgttttggttaagcaatttctttt

SEQ ID NO: 316706 - DNA, 1982 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggtttgtgctttgtttaactacctatgtgggcatcctaagatgaccatctacctcagtagatgtagagtgagcattagtagcatgttaaatctaagctattaacatttttaaacccttgttatactgcagtccgtaatttttgcttgcagattttttttaattctaaaaattagaaattaggtctgttattataaggtatttaccttttgttttcttttaaaacatttttaagttgtttaaaaccatgtcccttattgtaactccctgagatacatctacttagttaatttaatgttaagttttatgaaaaagccctgaaggtaaatgattcactccatgtatgcttacagagccttcaaataaatgcatgatgttatttctgttttaaataaatgagtaggttgattttattttcttaaagcttcctcacattgataatctggaaaaaaaaaaaacacattgaatttcagtataccaagggttgcagtgattttggttttcgtgaaagttcaagatttcctgtagcttaggtgccaaatgggcactgggtgttttattttatgccagattttcttgttcattcttgctatatttctagaatatctctaaataataaattcttctctctgttatttgtgtgtgtgatttttatagtggagaaggcaaatgcaaaacccttccagatgcctgaaaaacagtgggtcctctgcagctacaggggattctagacattaactaaaggccagcaagcactcaagtgccccaagtgttttcctggtgtaaccatttgttaactacattttctctctttttacattttaggctgttaaagtaatttgacagaaaaaaatgagcaggttttttggatctaaaaagccactgtgacaagaaattttaataccattttgtaaaattttctaaggcgtattttataattagtttgttcccaatgtactgctacttgatttgcattttggtaactataaattttactcgaatcactgaaatatgataaaactgctggattttaagttaataatttaatatgctgaccaggatttaaatgctttcccctttccttaataaactggtcagtggaagtggaatcttaatattgttcattttagatgctatctgaaatctttgaaaacaaatgtgagcatttacaccataccttgtaaaagttgtgaaatgtctagtccttaacagagaagttgcctctggttttctaaagaaattaacttatatttataaatgggttaagacatgttatgtaatagtacctctgtctccatgatattaaagtgtatgagcccagttttaaggttttgtaatgtatagatagataaatttttgagttagtgtgttttggttaagcaatttctttt

SEQ ID NO: 316707 - DNA, 451 bp, Homo sapiens
accagagattttcctttgtttgaataatatacagatttgtgatatttcacagttgttcttgagaaggatttttataaatgttgaaatttgaattagagtgtatgactttttatcctttttgtctcacttttattttgaaaattatttctatcgcaagaatattaagtggatgaattgtaaagaaaaaatagttcaaagaagctaagaagtaagataaagtgtactactaaaacagacaattggaataataataatagtcttgtgctttttggaagacttattggtggagaagtgacaattcaaatgtcattatcagtaaatatcatatattgagaattttatgatgtcacttaaatactaaacaggaaattggaatcctctaagaatctactgttatggtacgtgtaaccattaactttctgctcaataaaataattgacaaaagttatca

SEQ ID NO: 316708 - DNA, 3158 bp, Homo sapiens
tggggaagctggagtgggaggctgggtaacatagtaagacccctcccatttctttaaggagaaattgcttaaacattctttttactactgcgggtgcaacattgttaaattttatagcagcagtgtttcacatctaaaaaccactgtattctttaagaaacattcaacagtaagcctgtataacaaggtggcttaacttgcttgtggatatcctgttaattttgctttgaacttgggttagggtctgtgtttagcctgagaggtccttgtagggaagcttgtatcagaagttctaatgggtttgagttctcaggccatatatagcatcatgttagtgtttgagttgtgataaaaattatggggttttttgttaggcctaaattaaaagaaattatttttcttttcaacaatgaatctgaaattcttagtataaccaaatctgatgcatttacaattttatgtacacattggtgtgtttcattttttagaaactgtgaagcctcattcagatagtattaaaatacaggattttccttttcattaatgagtcctatgatgtaagtgttatattgatgttaaaatgaagtagttttgtaccctgggtgcataaaattgtcagagagaattaaaggagaaagaactcaaacttcatcagagatcttgatttaattcatgtgaagagtgtggattacccccaacccccaaccccatgactctaatacacattagagtgtattaactagggatggtgtgtttatttctgccttagggcactagctttccaaataacttttggtatgggcttgagccatccctgtattcatgcacagagtttcaaggcagaaatttgagctaccctgtaacttaacagttgaaaaaaaccctgcttcctgtgttatctgtcttacttacactgccatagcttgcagtttagcacttgtctttcttttacctaaggaagtaatttgttgagggaactagcccttttgcttattgaaactttgcagggtggcactagtggaacgtagtactactcccatgtgtgcctacattttttcttttatctgaaagtgctccaagccagaaatccttgattatttacagtgcataagagttcttacatgctgtgggtaaaagagtgcagggcatggaacctgtttattttatgcagttcaagaaaactcattgattattgagtacatgttcgttctcatgatattcatttgtccctgatataaaaattgttcatctttcttactctgagaaagccattaggaagtttctaagccccaaactactgttacctgtatctaaaaatagctggtattggtattataaagaaactgttgacaattttgtggtcccctcagtctctgagacttcagtaccaaattgtttttaacctgatacactgtaaatataagttatgattataagtttttatctgaactgcaattcactacattatttcagtgaacagtatatgattgagaatgttttcttttgaatttaactacattagtatacagttaggtttttttaatctgttttacttttgaaatgtgttggtttgtgaattagcatttgttttaactgctattctgtttctcttttatgttatttgtttattttttagtgattcgcctttgccagtctcatctcgtgtctgctttgttaagttccatgatccagactcagcagttgtggcacagcatctgacaaacactgtattcgttgacagagctttgatagtcgtaccatatgcagaaggtttgtgctttgtttaactacctatgtgggcatcctaagatgaccatctacctcagtagatgtagagtgagcattagtagcatgttaaatctaagctattaacatttttaaacccttgttatactgcagtccgtaatttttgcttgcagattttttttaattctaaaaattagaaattaggtctgttattataaggtatttaccttttgttttcttttaaaacatttttaagttgtttaaaaccatgtcccttattgtaactccctgagatacatctacttagttaatttaatgttaagttttatgaaaaagccctgaaggtaaatgattcactccatgtatgcttacagagccttcaaataaatgcatgatgttatttctgttttaaataaatgagtaggttgattttattttcttaaagcttcctcacattgataatctggaaaaaaaaaaaacacattgaatttcagtataccaagggttgcagtgattttggttttcgtgaaagttcaagatttcctgtagcttaggtgccaaatgggcactgggtgttttattttatgccagattttcttgttcattcttgctatatttctagaatatctctaaataataaattcttctctctgttatttgtgtgtgtgatttttatagtggagaaggcaaatgcaaaacccttccagatgcctgaaaaacagtgggtcctctgcagctacaggggattctagacattaactaaaggccagcaagcactcaagtgccccaagtgttttcctggtgtaaccatttgttaactacattttctctctttttacattttaggctgttaaagtaatttgacagaaaaaaatgagcaggttttttggatctaaaaagccactgtgacaagaaattttaataccattttgtaaaattttctaaggcgtattttataattagtttgttcccaatgtactgctacttgatttgcattttggtaactataaattttactcgaatcactgaaatatgataaaactgctggattttaagttaataatttaatatgctgaccaggatttaaatgctttcccctttccttaataaactggtcagtggaagtggaatcttaatattgttcattttagatgctatctgaaatctttgaaaacaaatgtgagcatttacaccataccttgtaaaagttgtgaaatgtctagtccttaacagagaagttgcctctggttttctaaagaaattaacttatatttataaatgggttaagacatgttatgtaatagtacctctgtctccatgatattaaagtgtatgagcccagttttaaggttttgtaatgtatagatagataaatttttgagttagtgtgttttggttaagcaatttctttt

SEQ ID NO: 316709 - DNA, 3824 bp, Homo sapiens
gcgcagtccagatgtcgtcagcaccagcgcctgggctggaggacagagaagccttttccgttgccggtgccggcctagcgtcctggaattacttcaatcaaaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316710 - DNA, 4466 bp, Homo sapiens
gcgcagtccagatgtcgtcagcaccagcgcctgggctggaggacagagaagccttttccgttgccggtgccggcctagcgtcctggaattacttcaatcaaaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaaaaaaaaaaaaaaaaaaaaaaaaaaaaaaaaaaaaaaaaaaaaaaaaaacaaaaaacaacgacgacaacaacaacgaagaggcgcccaccccatagagagcggacaccaaccaaggaggaggcaaccacaacaacagcaacccaccggcggagcccccacaagcgggcgcgccccctgcggacacccacagtaagacggacgagcagcgaaaaccgcacacagaccgatacaagcaacgaggagaacgagagcgccagaaaaaaaaatcagcgtcaacgcgagcagacccacttcaagtgacgcatacgcgcgcacaacacaagggtgggacagaccaaacacgactgtgggacaagcacaatgtcacgacgaatcacaggggggagttgcaggcgcctccagagagagagcaccgcctggtcacctaacgctggcgtgaagcacatacaaagtcaaggagcgcgcgcacatagatccacggtcggcgacaaaaagcgaggaagcaaggcgggcggcagcagaagagagaagcaaggcaaacagagagaggagagcaaataagacttactggagcaggcacaatgttatatagcaaatcaccgaaggacggagatcgtaagcagagcagactacacgagatgt

SEQ ID NO: 316711 - DNA, 3956 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316712 - DNA, 5130 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggttcttttccctggttcagcctgaactatataccaggccctgctgaaaataccacccaacagttttcttctgcagcttatccagtttctcttaagtgccctgtacatattgtatgttttatgatgagatgcagtttcttaatatgtattacagaaatactactggtatttgcaaatatgtagtttaattgtattattgaactctcattttgggggcttgggcacattaacagattaatccatctgtatagggcttttgctgttggatagaatttaaattgtctacataaatatttgttttaggacccttagattttatctgaatacacagattaggctttaaaaacagatatatatgtcatttttggcttaaggagtttggctaagttagcttttcaactggcactgtatggcagcattttttggtatggttagcatggcacatggcgaaacataaagcattttactgtacaggtaaggaatgtgccatgttgttttacctatctctctttctctctcactcccatgcacacatcctgtgtgtattcagagaccttcagaaacattcatattcattttcatgagtcagcaaaagccctacgcttgattccaacagaatatttcctttacatactttcttctcttaatttttacaaaatttgtatggtaggtgtaaaagaaaatcatagtaactgtaccatattattaacccctaaatcaaactttttttgtcttgtgtatcttgatttttctgtgtgctttatagtgaagcagccgacacgagtcgttgttcataaaacagcttttgaaagttgagagcacacccctggagaaccgactgtgcttgcttacgtttggttcatgacttaaaaatcgagtacaggtgatgaaatcttggcagtgttaacaaaaaagtagtgtgtattgtgctatttttttttactctagaaacttaaccatttgtagagaaaaaggaaacaaattttcacacattgaagttcattctgacataaaattaatgataaataatcatagaaatcaagctttgtattttagcgaacataagtactttcaacaaactcaggtggtgtatcagggagacattttctgggtgtttttgtgtgttttctgtcttagaaaagaatgtgttctaatgcaaggatgtttctctgcaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316713 - DNA, 5039 bp, Homo sapiens
agcggactgagaggaagagaccgggaaggcggagcgcggccgccagcaccgctcgagtccgccgaccgcctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggttcttttccctggttcagcctgaactatataccaggccctgctgaaaataccacccaacagttttcttctgcagcttatccagtttctcttaagtgccctgtacatattgtatgttttatgatgagatgcagtttcttaatatgtattacagaaatactactggtatttgcaaatatgtagtttaattgtattattgaactctcattttgggggcttgggcacattaacagattaatccatctgtatagggcttttgctgttggatagaatttaaattgtctacataaatatttgttttaggacccttagattttatctgaatacacagattaggctttaaaaacagatatatatgtcatttttggcttaaggagtttggctaagttagcttttcaactggcactgtatggcagcattttttggtatggttagcatggcacatggcgaaacataaagcattttactgtacaggtaaggaatgtgccatgttgttttacctatctctctttctctctcactcccatgcacacatcctgtgtgtattcagagaccttcagaaacattcatattcattttcatgagtcagcaaaagccctacgcttgattccaacagaatatttcctttacatactttcttctcttaatttttacaaaatttgtatggtaggtgtaaaagaaaatcatagtaactgtaccatattattaacccctaaatcaaactttttttgtcttgtgtatcttgatttttctgtgtgctttatagtgaagcagccgacacgagtcgttgttcataaaacagcttttgaaagttgagagcacacccctggagaaccgactgtgcttgcttacgtttggttcatgacttaaaaatcgagtacaggtgatgaaatcttggcagtgttaacaaaaaagtagtgtgtattgtgctatttttttttactctagaaacttaaccatttgtagagaaaaaggaaacaaattttcacacattgaagttcattctgacataaaattaatgataaataatcatagaaatcaagctttgtattttagcgaacataagtactttcaacaaactcaggtggtgtatcagggagacattttctgggtgtttttgtgtgttttctgtcttagaaaagaatgtgttctaatgcaaggatgtttctctgcaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316714 - DNA, 4838 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggttcttttccctggttcagcctgaactatataccaggccctgctgaaaataccacccaacagttttcttctgcagcttatccagtttctcttaagtgccctgtacatattgtatgttttatgatgagatgcagtttcttaatatgtattacagaaatactactggtatttgcaaatatgtagtttaattgtattattgaactctcattttgggggcttgggcacattaacagattaatccatctgtatagggcttttgctgttggatagaatttaaattgtctacataaatatttgttttaggacccttagattttatctgaatacacagattaggctttaaaaacagatatatatgtcatttttggcttaaggagtttggctaagttagcttttcaactggcactgtatggcagcattttttggtatggttagcatggcacatggcgaaacataaagcattttactgtacaggtaaggaatgtgccatgttgttttacctatctctctttctctctcactcccatgcacacatcctgtgtgtattcagagaccttcagaaacattcatattcattttcatgagtcagcaaaagccctacgcttgattccaacagaatatttcctttacatactttcttctcttaatttttacaaaatttgtatggtaggtgtaaaagaaaatcatagtaactgtaccatattattaacccctaaatcaaactttttttgtcttgtgtatcttgatttttctgtgtgctttatagtgaagcagccgacacgagtcgttgttcataaaacagcttttgaaagttgagagcacacccctggagaaccgactgtgcttgcttacgtttggttcatgacttaaaaatcgagtacaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316715 - DNA, 3989 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggagaaattggaatcctctaagaatctactgttatgtgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316716 - DNA, 3597 bp, Homo sapiens
gcgcagtccagatgtcgtcagcaccagcgcctgggctggaggacagagaagccttttccgttgccggtgccggcctagcgtcctggaattacttcaatcaatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316717 - DNA, 3894 bp, Homo sapiens
accagagattttcctttgtttgaataatatacagatttgtgatatttcacagttgttcttgagaaggatttttataaatgttgaaatttgaattagagtgtatgactttttatcctttttgtctcacttttattttgaaaattatttctatcgcaagaatattaagtggatgaattgtaaagaaaaaatagttcaaagaagctaagaagtaagataaagtgtactactaaaacagacaattggaataataataatagtcttgtgctttttggaagacttattggtggagaagtgacaattcaaatgtcattatcagtaaatatcatatattgagaattttatgatgtcacttaaatactaaacaggaaattggaatcctctaagaatctactgttatgtgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316718 - DNA, 3977 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagtttgcacatttgtgattctagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316719 - DNA, 3989 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagtatatttgaagtaacatggaattcaagagagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316720 - DNA, 3906 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316721 - DNA, 3260 bp, Homo sapiens
tacctggagtgatgctctgagcatggaaagagggtgctcactacgtctatgatctgtccctgggtgcacttggtcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316722 - DNA, 3907 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggtcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316723 - DNA, 3873 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaaaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316724 - DNA, 3323 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctgcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316725 - DNA, 3546 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaaaaaaaaaaaaaaaaaaaaaaaaaaaaaaaaaaaaaaaaaaaaaaaaaacaaaaaacaacgacgacaacaacaacgaagaggcgcccaccccatagagagcggacaccaaccaaggaggaggcaaccacaacaacagcaacccaccggcggagcccccacaagcgggcgcgccccctgcggacacccacagtaagacggacgagcagcgaaaaccgcacacagaccgatacaagcaacgaggagaacgagagcgccagaaaaaaaaatcagcgtcaacgcgagcagacccacttcaagtgacgcatacgcgcgcacaacacaagggtgggacagaccaaacacgactgtgggacaagcacaatgtcacgacgaatcacaggggggagttgcaggcgcctccagagagagagcaccgcctggtcacctaacgctggcgtgaagcacatacaaagtcaaggagcgcgcgcacatagatccacggtcggcgacaaaaagcgaggaagcaaggcgggcggcagcagaagagagaagcaaggcaaacagagagaggagagcaaataagacttactggagcaggcacaatgttatatagcaaatcaccgaaggacggagatcgtaagcagagcagactacacgagatgt

SEQ ID NO: 316726 - DNA, 2957 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaactgccgaattcttcgtcggatgcaaattccctataggatgagatgcaggcgtg

SEQ ID NO: 316727 - DNA, 2838 bp, Homo sapiens
tgtttccctttgtctcaatgaagctgagcttctttcccatgattaggaatttgcatttccttttctgtgaactgcctattcatcttctgtcaattttttattggtgactttaatctttcatattgatttataggacccctttagaatcaatattaaaaacatttatacaatgcaacatcaaattatcattctcagccaggagcggtggtgtgcacctgtagtcccagctatttggaaggatcacctgagcctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316728 - DNA, 2893 bp, Homo sapiens
  misc_feature (217)..(217): n is a, c, g, or t
  misc_feature (241)..(241): n is a, c, g, or t
ttgaaaggaaagtgcaatgaaatttgttgaaccttaaaaggggaaacttagacaccccccctcaagcgcaggaccaagtgcagagtggactctttctggatgttgtagtcagacagggtgcgtccatcttccagctgtttcccagcaaagatcaacctctgctgatcaggagggatgccttccttatcttggatctttgccttgacattctcgatgntgtcactgggctccacctcgaggntgatggtcttaccagtcagggtcttcacgaagatctgcatcccacctctgagacggagcaccaggtgcagggtggactctttctgctctccgaattcggcacgaggaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316729 - DNA, 2448 bp, Homo sapiens
cggacgcgtgggtcgacccacgcgtccgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316730 - DNA, 2488 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttgggggccactaggggttacatccggaacgagtccattaactgcttggcggggtcaatgccctttgcgggacaggtgccctcatacagtggggattcgggaatattcacagctacgaagacaccgggctacgaagaactccctgtagcccattcgggggggagcttgag

SEQ ID NO: 316731 - DNA, 1891 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtataccggttaatggtctccttgggtgaatcactaggccgtttggcacctcaaccaattttacggctggtttaaggggatagccgtacacataaatttatcaagtttaaatgtcggccactttcgggaaagttgacccgtattggggtaacaa

SEQ ID NO: 316732 - DNA, 1730 bp, Homo sapiens
cggacgcgtgggtcgacccacgcgtccgaaggaaagaaagaaaaaaaccttatctcttgcccttaagatagactcaggataggtagatagctttcactgagtctatcttaaaggaaagaaagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316733 - DNA, 1874 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaagaagaaaaaagaggcattccaggatcaagatcacgttctaggaggaggaggatccctcatcttctagaaacagggcggtcaagaagcggatcggagacggggggcaccatctaagtctaggagtcggggaggatccaaagcccagggggagagatctcattcggagaagagtagaggtccaggggccatccaacagagcccaacggcaggagcccacgcacgaacgtgttaccgaacaacacaacaaaaacatgggcggcccccccgcaacgtcacacacacggtggggggcccggatagacgtgggaccgccaacacgcgcgcagtggggctccacaaagcgggcgccgtcgacacacgagggggctggtataggacgcacacg

SEQ ID NO: 316734 - DNA, 803 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggagtgagtatcgtccaccatcactgttcctgctaacgccgcctcagcctgggcctaacacacacaatttccttaggcccctgtcgctgcttccccgggccaggctgcttgagtggctggtggctggtggatttacttaagacggttgtgttccaggcctacaaaaaaatgcagagaggcagggccagggctttttggaattaggaaacactggctgttattctcgggaaattttttttttccgccttaaattgtgccaacgtggtcgtttggctttggggacttaacgcaagactaaccgcagtctgtacgtcgtatataggttaaatcccttttttaaaaaact

SEQ ID NO: 316735 - DNA, 249 bp, Homo sapiens
gtagtttttcttttcagcagttacagttcttaagaatgttttaatgtattctccttctgacttgtgacttaaacaccattaaggactgaacattttagtcctataaacaagttagttttgtagcctgtgttacttctccaaggttttgaagttggatctttgctgtactacttatatcctgtgaaattgagtcaggctcatcatctaaacaagttaaacctgttgctgtacattttactgtcattctag

SEQ ID NO: 316736 - DNA, 3902 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316737 - DNA, 3260 bp, Homo sapiens
ggaacgctatacaggacacagtataccaggaaacagctatcatcacggaaagctatactcagggagacaggattaccctggaacagattgaactcgcagaactctttcagcaggatcaattgctgaagctgatgaatactgtagctcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316738 - DNA, 3903 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316739 - DNA, 2838 bp, Homo sapiens
tagagctcggccccattaacattcatttctgagaaacgcaggtagaatgtgcagagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316740 - DNA, 2612 bp, Homo sapiens
agaatcgcttgaacacaggaggaggaggttagcagtgaaccgagatcacaccactgcagtccagcctgggcaacagagctgactcagtctcatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316741 - DNA, 2844 bp, Homo sapiens
  misc_feature (217)..(217): n is a, c, g, or t
  misc_feature (241)..(241): n is a, c, g, or t
ttgaaaggaaagtgcaatgaaatttgttgaaccttaaaaggggaaacttagacaccccccctcaagcgcaggaccaagtgcagagtggactctttctggatgttgtagtcagacagggtgcgtccatcttccagctgtttcccagcaaagatcaacctctgctgatcaggagggatgccttccttatcttggatctttgccttgacattctcgatgntgtcactgggctccacctcgaggntgatggtcttaccagtcagggtcttcacgaagatctgcatcccacctctgagacggagcaccaggtgcagggtggactctttctgctctccgaattcggcacgaggaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggtcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttatttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgttgggtggctggggttaagggaaaatgagacttggaattgtagcttttatccaagtttgagtataaatagggtttgtttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 316742 - DNA, 1703 bp, Homo sapiens
  misc_feature (1685)..(1685): n is a, c, g, or t
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgactggagnccctggtatcctctacga

SEQ ID NO: 316743 - DNA, 1944 bp, Homo sapiens
agtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgcaacgcaacgacacgaacgaacgacgtacacacgactaacggacacacacggacccgggaacagacacaatccgacgacgtcgactaaacgactgtacaacaccacggttaccccgggacttactgactgaccgacggacacacgggggttattgaacaaggtggacgaaacagacgacaacaacacaacaacacaacagaagggggaggagccgaccccataaaagatactccccctgtcaagaggggcccccacacgggcatatacgcgccgataccccagcagatatatcatcatggaagcacaacacgggggggtcacgcactaaataacgcgagaacgtcagcaacaaaaacaataaagagcacaatgggacaacaaggaggacgcgcacggctataacacaagaagcgagacaagacgcagaacactgggggagacacacacccggccacccgaccacgcgggaacacttaataggcgacacaacggacaaccccataacacg

SEQ ID NO: 316744 - DNA, 6830 bp, Homo sapiens
gagaaggtaaacgagcaagactaatactaatgagaggatcacctgagcccaggagtttgagactacagtagctatgatggtgccactacactccagcctgggtaaaagagtgagacctcatctctttaaaaaaaaattctgccaggagcggtggttcatgcctataatcccaacactttaggaggctgaggctggtggatcacttgaagccaggaattcaagacgaacctgggcaaaaagtgagacccctgtctctacaaaaaaaattaattttttaaaaaaactagctgggcagctggcgtggtggctcacacctgtaatcccagcactttgggaggctgaggtgggtggatcatgcggtcaggagttcgagaccagcctggccaacatagtgaaaccccatctctactaaaaatacaaaaaaaaaaaattaaccaggtgtagtggcgggcgcctataatcccagctacttgggaggccaaggcaggagaatcgctcgaaaccagaaggtggaggtggcagtgagccgagatcacaccattgcactccagcctgggcaacaagagcaaaactctatctcaaaaaaaaaaaaaaaaaactagctggacatggtggcatgtacatacagtcccagctactcaggaggctgaagcaggatgatagcttgattacccaagagttcaaggctgcagtgaactatgattgtgccactgcactccagcctgggcaacagagcaagaccccatctcgtttaaaaaaaaattatattatttgaatgggtatcttgtttgttttaactgtaaatatttacagtacttggttttacttgggagatttgtatagcttacaaatcttgtccctatggattcagttctcttacccacagacacagaaccaaaatcaggagttccacaaggagtggtggtgagtcctgcctttggcaaacacgcacctgcaagctttgctctagggattgaatcccttacccagtggggcccataggctagaggactttgtggaactttggaacttgtcttaacaatggaggaggggataaaataagtttatctttgggctggaatttgtactaatttttctttctcttgtagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccaccgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggcataaagccgtatgagtgtaatatctgtgcaaagaggtttatgtggagggacagtttccaccggcatgtgacttcttgtactaagtcctacgaagctgcaaaggctgagcagaatacaactgaggctaactaaaaataggatctggcccttgagtggcatgcacaaaaataaactatggtaattaatgcaaatctgggcacagatgatgcgtgctacttgctattatgagagaagcttaaaaaaaaaaaggaagatatttctgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaaatttcatacttatgccatgcttttacctttagatacacacgttacagtaatccacgtggtgaagtgcatgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttg

SEQ ID NO: 316745 - DNA, 7015 bp, Homo sapiens
gagaaggtaaacgagcaagactaatactaatgagaggatcacctgagcccaggagtttgagactacagtagctatgatggtgccactacactccagcctgggtaaaagagtgagacctcatctctttaaaaaaaaattctgccaggagcggtggttcatgcctataatcccaacactttaggaggctgaggctggtggatcacttgaagccaggaattcaagacgaacctgggcaaaaagtgagacccctgtctctacaaaaaaaattaattttttaaaaaaactagctgggcagctggcgtggtggctcacacctgtaatcccagcactttgggaggctgaggtgggtggatcatgcggtcaggagttcgagaccagcctggccaacatagtgaaaccccatctctactaaaaatacaaaaaaaaaaaattaaccaggtgtagtggcgggcgcctataatcccagctacttgggaggccaaggcaggagaatcgctcgaaaccagaaggtggaggtggcagtgagccgagatcacaccattgcactccagcctgggcaacaagagcaaaactctatctcaaaaaaaaaaaaaaaaaactagctggacatggtggcatgtacatacagtcccagctactcaggaggctgaagcaggatgatagcttgattacccaagagttcaaggctgcagtgaactatgattgtgccactgcactccagcctgggcaacagagcaagaccccatctcgtttaaaaaaaaattatattatttgaatgggtatcttgtttgttttaactgtaaatatttacagtacttggttttacttgggagatttgtatagcttacaaatcttgtccctatggattcagttctcttacccacagacacagaaccaaaatcaggagttccacaaggagtggtggtgagtcctgcctttggcaaacacgcacctgcaagctttgctctagggattgaatcccttacccagtggggcccataggctagaggactttgtggaactttggaacttgtcttaacaatggaggaggggataaaataagtttatctttgggctggaatttgtactaatttttctttctcttgtagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccaccgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggcataaagccgtatgagtgtaatatctgtgcaaagaggtttatgtggagggacagtttccaccggcatgtgacttcttgtactaagtcctacgaagctgcaaaggctgagcagaatacaactgaggctaactaaaaataggatctggcccttgagtggcatgcacaaaaataaactatggtaattaatgcaaatctgggcacagatgatgcgtgctacttgctattatgagagaagcttaaaaaaaaaaaggaagatatttctgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaaatttcatacttatgccatgcttttacctttagatacacacgttacagtaatccacgtggtgaagtgcatgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttgtaaaagttttgtttttcactatgagtagatgaccacatcttgtttgactctgggttttgccacctgagaatacagttatatggtggcgttttggtaagtaaatgccaaataatctgatccaatgggcagtgagtgactgccaggcaggcatttatagtaatattttagacccccactggcccctt

SEQ ID NO: 316746 - DNA, 5951 bp, Homo sapiens
tgaaggcacaggctgaatctgttgcggcagctgaggctacaacaggcctgcgccggcggcagagaggatatcttgggcgggggatgtgagcgctgagcccttggcagaagtcaatgtgattttaatttgaagcaaaactgaaatgggttcttcttcctcattctattcatgttgctttttgatggccatggcataaggaactctatcccaggaatacagctttgcattagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccaccgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggcataaagccgtatgagtgtaatatctgtgcaaagaggtttatgtggagggacagtttccaccggcatgtgacttcttgtactaagtcctacgaagctgcaaaggctgagcagaatacaactgaggctaactaaaaataggatctggcccttgagtggcatgcacaaaaataaactatggtaattaatgcaaatctgggcacagatgatgcgtgctacttgctattatgagagaagcttaaaaaaaaaaaggaagatatttctgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaaatttcatacttatgccatgcttttacctttagatacacacgttacagtaatccacgtggtgaagtgcatgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttg

SEQ ID NO: 316747 - DNA, 4634 bp, Homo sapiens
tgaaggcacaggctgaatctgttgcggcagctgaggctacaacaggcctgcgccggcggcagagaggatatcttgggcgggggatgtgagcgctgagcccttggcagaagtcaatgtgattttaatttgaagcaaaactgaaatgggttcttcttcctcattctattcatgttgctttttgatggccatggcataaggaactctatcccaggaatacagctttgcattagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccaccgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggcataaagccgtatgagtgtaatatctgtgcaaagaggtttatgtggagggacagtttccaccggcatgtgacttcttgtactaagtcctacgaagctgcaaaggctgagcagaatacaactgaggctaactaaaaataggatctggcccttgagtggcatgcacaaaaataaactatggtaattaatgcaaatctgggcacagatgatgcgtgctacttgctattatgagagaagcttaaaaaaaaaaaggaagatatttctgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttgtaaaagttttgtttttcactatgagtagatgaccacatcttgtttgactctgggttttgccacctgagaatacagttatatggtggcgttttggtaagtaaatgccaaataatctgatccaatgggcagtgagtgactgccaggcaggcatttatagtaatattttagacccccactggcccctt

SEQ ID NO: 316748 - DNA, 5828 bp, Homo sapiens
tgaaggcacaggctgaatctgttgcggcagctgaggctacaacaggcctgcgccggcggcagagaggatatcttgggcgggggatgtgagcgctgagcccttggcagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccaccgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggcataaagccgtatgagtgtaatatctgtgcaaagaggtttatgtggagggacagtttccaccggcatgtgacttcttgtactaagtcctacgaagctgcaaaggctgagcagaatacaactgaggctaactaaaaataggatctggcccttgagtggcatgcacaaaaataaactatggtaattaatgcaaatctgggcacagatgatgcgtgctacttgctattatgagagaagcttaaaaaaaaaaaggaagatatttctgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaaatttcatacttatgccatgcttttacctttagatacacacgttacagtaatccacgtggtgaagtgcatgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttg

SEQ ID NO: 316749 - DNA, 4191 bp, Homo sapiens
gcggccgctccagcatcagaatggttgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaaatttcatacttatgccatgcttttacctttagatacacacgttacagtaatccacgtggtgaagtgcatgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttg

SEQ ID NO: 316750 - DNA, 2277 bp, Homo sapiens
gtgccgctccgagaaacagcgtaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaaatttcatacttatgccatgcttttacctttagatacacacgttacagtaatccacgtggtgaagtgcatgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttg

SEQ ID NO: 316751 - DNA, 2134 bp, Homo sapiens
gagtccgcggcgttccccggctgcagccggggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcgtcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaattgaaacactcagaaaaacagttgaggactatttctgcttttgctatgggaaagctttaggcaaatccacagtggtacctgtaccatatgagaagatgctgcgagaccagtcggctgtggtagtgcaggggcttacggaaggtgttgcctttaaacaccccgagaactatgatcttgcaaccctgaaatggattttggagaacaaagcagggatttcattcatcattaagagaccttttttagagccaaagaagcatgtaggtaagtaagtgctttgcttccttgatagctggctggcctccgttttgctagattttcatacactttaatggtttctgttttattgtctttgagaatatgatgtcagacattttcggatgggctgtttagatgttatataatccacaaaaggttcattgagctaaaaaagtggagacttgttttttt

SEQ ID NO: 316752 - DNA, 815 bp, Homo sapiens
  misc_feature (721)..(721): n is a, c, g, or t
  misc_feature (786)..(786): n is a, c, g, or t
  misc_feature (794)..(794): n is a, c, g, or t
gagtccgcggcgttccccggctgcagccggggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcagtgaaattgctgcgggctggggtcaagcttctaaaaactgggncaagaacaaaggcttgaagctcaatggaatccgccccttgaaggtcaacctaacccccctggttnccctgccnaaagttcaaaagggggggaaa

SEQ ID NO: 316753 - DNA, 410 bp, Homo sapiens
  misc_feature (313)..(313): n is a, c, g, or t
  misc_feature (317)..(317): n is a, c, g, or t
  misc_feature (382)..(382): n is a, c, g, or t
gagtccgcggcgttccccggctgcagccggggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttcttttaggttttntgcnttttggttttgttgttttttattaaagttaagtaaacactgcctaaaaacgggtaaggatgaaanaagggggccgggtagaaagctcactttt

SEQ ID NO: 316754 - DNA, 243 bp, Homo sapiens
ctgcactgtgaactgtctgccgtccattctccttgtgccctgcacacctgcgctccttcaacttgaacttccttcctactctgctttgtatttttgctggtcctggttttgatttttctgctgtacttgtagtttatgatggttcggctgggaccaggggcctggaagtggcatatctcagtctctgtcctggggaggtcctccctctgccaggagggcagcctgcctagggtgagccgtgag

SEQ ID NO: 316755 - DNA, 2556 bp, Homo sapiens
gagtccgcggcgttccccggctgcagccggggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcgtcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattggggagggaagggcgttagataaggcactctgggctgtcaggagactgcctactgggtgggtcaacttatttcccactatgacatttatatctttatttttcacaattatattgaaggcagtgggagaggggagagggtgggttttacctgatattaaggggtggcaccccttccccaggcctgatgcaggtccatctagacagctcagattagcctaggccatgccctagggacacggcctaggggagctgggctggagggggtctgcctgggtaaggggatctggcttggccctgagctgcttagggacaggtgagtccttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtctagtctggaatggtagggatgctgcttcctggggcaggggaggacccagggcagagggtgtgagcagagtggctgggtctgctggagactgctggacccctcactgctctgccctccccgcaggcatctgcttctgcagcctgaaccttaggaccgtgatgggccaggctctgatgggcctgcctgcatgccggggtgcctggagtttgatttggtgctaagagaggtatagattgtacctctcaattcctgcttctgaaacgtggggtaggaggt

SEQ ID NO: 316756 - DNA, 1707 bp, Homo sapiens
gagtccgcggcgttccccggctgcagccggggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcgtcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtcaactcagctatttcagaggtaccatcccctgttggccacatatagtgcccgtctgtaaagccttcgataaacaaaaaaaa

SEQ ID NO: 316757 - DNA, 2000 bp, Homo sapiens
gagtccgcggcgttccccggctgcagccggggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcgtcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcagttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtctaagaaaaaaaaaaaaaaaaaaaaaacaacaaaaaaaaaaaaaaaaagagagagaggggcgcgcgcgcgcctcgctaagagaggatattcccccggagaggggcgcccaagtttcacgcgcgcgtgcccccgcgttttttgggcacagagggggcgccccctaattggaggggaggcgcacatatatataagcgacagagcgcacagagggggcgcgcggagggtatataaacaccagcgctgggcgtcacgcggggggaaaaccacggcggccaccacgggggggaacccctcggcgggaaagggcgacacaccctttaacagcggcggggggggggggggacacaacctactgtgggggacacacaacaccttacccccagccgaggagatttttaaccaggcccctaaggaggggacacacttcac

SEQ ID NO: 316758 - DNA, 2472 bp, Homo sapiens
gagtccgcggcgttccccggctgcagccggggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattggggagggaagggcgttagataaggcactctgggctgtcaggagactgcctactgggtgggtcaacttatttcccactatgacatttatatctttatttttcacaattatattgaaggcagtgggagaggggagagggtgggttttacctgatattaaggggtggcaccccttccccaggcctgatgcaggtccatctagacagctcagattagcctaggccatgccctagggacacggcctaggggagctgggctggagggggtctgcctgggtaaggggatctggcttggccctgagctgcttagggacaggtgagtccttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtctagtctggaatggtagggatgctgcttcctggggcaggggaggacccagggcagagggtgtgagcagagtggctgggtctgctggagactgctggacccctcactgctctgccctccccgcaggcatctgcttctgcagcctgaaccttaggaccgtgatgggccaggctctgatgggcctgcctgcatgccggggtgcctggagtttgatttggtgctaagagaggtatagattgtacctctcaattcctgcttctgaaacgtggggtaggaggt

SEQ ID NO: 316759 - DNA, 2706 bp, Homo sapiens
gagtccgcggcgttccccggctgcagccggggagggggccgaggagtgactgagccccgggctgtgcagtccgacgccgactgaggcacgagcgggtgacgctgggcctgcagcgcggagcagaaagcagaacccgcagccccttacccaggagcagcagtggtcatcttctggcacggagcctctccaggatgggcacatggctagagactggatcaggcctcagagggcttcagactgttggtcaggaaagcaacaacttttccagatcatcatcatcatcatcataagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcgtcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattggggagggaagggcgttagataaggcactctgggctgtcaggagactgcctactgggtgggtcaacttatttcccactatgacatttatatctttatttttcacaattatattgaaggcagtgggagaggggagagggtgggttttacctgatattaaggggtggcaccccttccccaggcctgatgcaggtccatctagacagctcagattagcctaggccatgccctagggacacggcctaggggagctgggctggagggggtctgcctgggtaaggggatctggcttggccctgagctgcttagggacaggtgagtccttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtctagtctggaatggtagggatgctgcttcctggggcaggggaggacccagggcagagggtgtgagcagagtggctgggtctgctggagactgctggacccctcactgctctgccctccccgcaggcatctgcttctgcagcctgaaccttaggaccgtgatgggccaggctctgatgggcctgcctgcatgccggggtgcctggagtttgatttggtgctaagagaggtatagattgtacctctcaattcctgcttctgaaacgtggggtaggaggt

SEQ ID NO: 316760 - DNA, 2468 bp, Homo sapiens
gagccggaccccctaagacttcaagttggaaactcagtggggcttttccagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcgtcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattggggagggaagggcgttagataaggcactctgggctgtcaggagactgcctactgggtgggtcaacttatttcccactatgacatttatatctttatttttcacaattatattgaaggcagtgggagaggggagagggtgggttttacctgatattaaggggtggcaccccttccccaggcctgatgcaggtccatctagacagctcagattagcctaggccatgccctagggacacggcctaggggagctgggctggagggggtctgcctgggtaaggggatctggcttggccctgagctgcttagggacaggtgagtccttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtctagtctggaatggtagggatgctgcttcctggggcaggggaggacccagggcagagggtgtgagcagagtggctgggtctgctggagactgctggacccctcactgctctgccctccccgcaggcatctgcttctgcagcctgaaccttaggaccgtgatgggccaggctctgatgggcctgcctgcatgccggggtgcctggagtttgatttggtgctaagagaggtatagattgtacctctcaattcctgcttctgaaacgtggggtaggaggt

SEQ ID NO: 316761 - DNA, 2245 bp, Homo sapiens
gggacggttaggccaggtgtttatacctgctgtgcccactgattttgtactacttcttccccctagaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcgtcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattggggagggaagggcgttagataaggcactctgggctgtcaggagactgcctactgggtgggtcaacttatttcccactatgacatttatatctttatttttcacaattatattgaaggcagtgggagaggggagagggtgggttttacctgatattaaggggtggcaccccttccccaggcctgatgcaggtccatctagacagctcagattagcctaggccatgccctagggacacggcctaggggagctgggctggagggggtctgcctgggtaaggggatctggcttggccctgagctgcttagggacaggtgagtccttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtctagtctggaatggtagggatgctgcttcctggggcaggggaggacccagggcagagggtgtgagcagagtggctgggtctgctggagactgctggacccctcactgctctgccctccccgcaggcatctgcttctgcagcctgaaccttaggaccgtgatgggccaggctctgatgggcctgcctgcatgccggggtgcctggagtttgatttggtgctaagagaggtatagattgtacctctcaattcctgcttctgaaacgtggggtaggaggt

SEQ ID NO: 316762 - DNA, 2252 bp, Homo sapiens
gggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcgtcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattggggagggaagggcgttagataaggcactctgggctgtcaggagactgcctactgggtgggtcaacttatttcccactatgacatttatatctttatttttcacaattatattgaaggcagtgggagaggggagagggtgggttttacctgatattaaggggtggcaccccttccccaggcctgatgcaggtccatctagacagctcagattagcctaggccatgccctagggacacggcctaggggagctgggctggagggggtctgcctgggtaaggggatctggcttggccctgagctgcttagggacaggtgagtccttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtctagtctggaatggtagggatgctgcttcctggggcaggggaggacccagggcagagggtgtgagcagagtggctgggtctgctggagactgctggacccctcactgctctgccctccccgcaggcatctgcttctgcagcctgaaccttaggaccgtgatgggccaggctctgatgggcctgcctgcatgccggggtgcctggagtttgatttggtgctaagagaggtatagattgtacctctcaattcctgcttctgaaacgtggggtaggaggt

SEQ ID NO: 316763 - DNA, 2389 bp, Homo sapiens
acctattggatagcggatgaggggctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcgtcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattggggagggaagggcgttagataaggcactctgggctgtcaggagactgcctactgggtgggtcaacttatttcccactatgacatttatatctttatttttcacaattatattgaaggcagtgggagaggggagagggtgggttttacctgatattaaggggtggcaccccttccccaggcctgatgcaggtccatctagacagctcagattagcctaggccatgccctagggacacggcctaggggagctgggctggagggggtctgcctgggtaaggggatctggcttggccctgagctgcttagggacaggtgagtccttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtctagtctggaatggtagggatgctgcttcctggggcaggggaggacccagggcagagggtgtgagcagagtggctgggtctgctggagactgctggacccctcactgctctgccctccccgcaggcatctgcttctgcagcctgaaccttaggaccgtgatgggccaggctctgatgggcctgcctgcatgccggggtgcctggagtttgatttggtgctaagagaggtatagattgtacctctcaattcctgcttctgaaacgtggggtaggaggt

SEQ ID NO: 316764 - DNA, 2182 bp, Homo sapiens
ccagccgagtgcagcctgaccgcggcgctggccgtaacatcgggtggagagcatctctcggggcacgcaggctgggtgcacctggtcggggaccctcagctgactttgtgcctgctctgtgtccccagtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcgtcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattggggagggaagggcgttagataaggcactctgggctgtcaggagactgcctactgggtgggtcaacttatttcccactatgacatttatatctttatttttcacaattatattgaaggcagtgggagaggggagagggtgggttttacctgatattaaggggtggcaccccttccccaggcctgatgcaggtccatctagacagctcagattagcctaggccatgccctagggacacggcctaggggagctgggctggagggggtctgcctgggtaaggggatctggcttggccctgagctgcttagggacaggtgagtccttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtctagtctggaatggtagggatgctgcttcctggggcaggggaggacccagggcagagggtgtgagcagagtggctgggtctgctggagactgctggacccctcactgctctgccctccccgcaggcatctgcttctgcagcctgaaccttaggaccgtgatgggccaggctctgatgggcctgcctgcatgccggggtgcctggagtttgatttggtgctaagagaggtatagattgtacctctcaattcctgcttctgaaacgtggggtaggaggt

SEQ ID NO: 316765 - DNA, 1488 bp, Homo sapiens
agatgagcagaggaaccacagacacagcagggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattggggagggaagggcgttagataaggcactctgggctgtcaggagactgcctactgggtgggtcaacttatttcccactatgacatttatatctttatttttcacaattatattgaaggcagtgggagaggggagagggtgggttttacctgatattaaggggtggcaccccttccccaggcctgatgcaggtccatctagacagctcagattagcctaggccatgccctagggacacggcctaggggagctgggctggagggggtctgcctgggtaaggggatctggcttggccctgagctgcttagggacaggtgagtccttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtctagtctggaatggtagggatgctgcttcctggggcaggggaggacccagggcagagggtgtgagcagagtggctgggtctgctggagactgctggacccctcactgctctgccctccccgcaggcatctgcttctgcagcctgaaccttaggaccgtgatgggccaggctctgatgggcctgcctgcatgccggggtgcctggagtttgatttggtgctaagagaggtatagattgtacctctcaattcctgcttctgaaacgtggggtaggaggt

SEQ ID NO: 316766 - DNA, 581 bp, Homo sapiens
gcggccgcctactactactactgctcgaattcaagcttctaacgatgtacggggacttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtctagtctggaatggtagggatgctgcttcctggggcaggggaggacccagggcagagggtgtgagcagagtggctgggtctgctggagactgctggacccctcactgctctgccctccccgcaggcatctgcttctgcagcctgaaccttaggaccgtgatgggccaggctctgatgggcctgcctgcatgccggggtgcctggagtttgatttggtgctaagagaggtatagattgtacctctcaattcctgcttctgaaacgtggggtaggaggt

SEQ ID NO: 316767 - DNA, 626 bp, Homo sapiens
tgcactgtgaactgtctgccgtccattctccttgtgccctgcacacctgcgctccttcaacttgaacttccttcctactctgctttgtatttttgctggtcctggttttgatttttctgctgtacttgtagtttatgatggttcggctgggaccaggggcctggaagtggcatatctcagtctctgtcctggggaggtcctccctctgccaggagggcagcctgcctagggtgagccgtgagcacaagcagtctgtcccctgccttgcccaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggaggtgtgcggggggctgcggatcgggggcggggctccgagggcgttgggggccatctgggctactgctcagcaattccttcctgcatttagttccttcccttaattcatctgtcatttgtaccttcatctacttctttgttaatgtatttat

SEQ ID NO: 316768 - DNA, 465 bp, Homo sapiens
ctccctctgctgcctgcatcacagggtggttgtgaggctcaagttgaggatccacttaatccccatgtaaacctggatggtgaggctggggcgtctgaggccgggacacccagcctccctctgactctccgcctctccccacagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccaccctgactgaaagtagggggctttctggggcctagcgatctctcctggcctatccgctgccagccttgagccctggctgttctgtggttcctctgctcaccgcccatcagggttctcttagcaactca

SEQ ID NO: 316769 - DNA, 478 bp, Homo sapiens
tggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctca

SEQ ID NO: 316770 - DNA, 2260 bp, Homo sapiens
aagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttcta

SEQ ID NO: 316771 - DNA, 2615 bp, Homo sapiens
ctctggatgcaaagtgtcgcagcacatgcctgcggacgggtgttcagtcactcaggcagcctttacaagagacctgtgaggaccaggctctgggactccacggtgaatgaggcagacacagccccatcctctgtgtcagtctgaggtgggtgtcagccatgtcattgtccaactctaccatcacaacttgggcttcgagcaggtggagacagtggtaagcggggagaggcaatagtgggcatctcactgggtgacctgggaggaccctgggcaggtgatggggaagctgaggctcacacatcctgcgggtggggacccagcctgaagaatgggctggtgtcacacagcattggagctgagactggggtctttagaatttcctaggtgggggcctgggaaccaacaggggctcaaggaaccaaggtgtccccacagtgagtggcactgtcaggtctaggatgggggtctcgggacccctggtcctggttctttccactgaattcagacacttgtatttgcctaagtatgagcaaaccacatacacatgtgcccatgtggccagggagaccagtgcgctgaagctgaggcccagagtacacctggcctgtgtcctgagtgttcacacacccaccaagcatccaggggcaactcctggtgcctcagccatcgggggctgtcccttccctgaggcccaggcccctccatctccctccaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttcta

SEQ ID NO: 316772 - DNA, 2352 bp, Homo sapiens
aagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggaggtgaggccctgcctgccagtccccctactcctctgctggccactgtgactgcagcatatgccctcagcatgtgtccctctctcccaccccagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttcta

SEQ ID NO: 316773 - DNA, 2698 bp, Homo sapiens
aagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagagctgggatttccatcctcaactggcagagatgagagcctggagcattgcagatgccagggacttcacaaatgaaggcacagcatgggaaacctgcgtgggttccagggcagtccagcctgcaggggcccagggagtggtcagtaggcatttgtcacagccaaatgccagtggaaggagcagccgcccaggcagccctctactgatgagagtaacctcacccgtgcactagtttacagagcattcactgccccagcttatcccaggcctcccgcttccctctgcgggtggggtgctgagcaggcattattggcctgcatgttttactgatgaggaaactgaggctgggagagtctgtggtaggggtcaagcaggtccacagtggcggggcatggcagtggtggctgggcaggtccttgcagccttccctctccggcaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttcta

SEQ ID NO: 316774 - DNA, 2118 bp, Homo sapiens
aagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttcta

SEQ ID NO: 316775 - DNA, 1821 bp, Homo sapiens
gtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttcta

SEQ ID NO: 316776 - DNA, 1641 bp, Homo sapiens
  misc_feature (1509)..(1509): n is a, c, g, or t
  misc_feature (1560)..(1560): n is a, c, g, or t
  misc_feature (1634)..(1634): n is a, c, g, or t
  misc_feature (1639)..(1639): n is a, c, g, or t
aagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagagctgggatttccatcctcaactggcagagatgagagcctggagcattgcagatgccagggacttcacaaatgaaggcacagcatgggaaacctgcgtgggttccagggcagtccagcctgcaggggcccagggagtggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatgggctattgctaatttncttgcggcggccgcaagtttatttcctttagttgaggggttaatttttagnttggcatttggccttcttttttaacaaacgttcgtgacttggggaaaaacccggggctttaaacccactttaanttcgnct

SEQ ID NO: 316777 - DNA, 1115 bp, Homo sapiens
ctctggatgcaaagtgtcgcagcacatgcctgcggacgggtgttcagtcactcaggcagcctttacaagagacctgtgaggaccaggctctgggactccacggtgaatgaggcagacacagccccatcctctgtgtcagtctgaggtgggtgtcagccatgtcattgtccaactctaccatcacaacttgggcttcgagcaggtggagacagtggtaagcggggagaggcaatagtgggcatctcactgggtgacctgggaggaccctgggcaggtgatggggaagctgaggctcacacatcctgcgggtggggacccagcctgaagaatgggctggtgtcacacagcattggagctgagactggggtctttagaatttcctaggtgggggcctgggaaccaacaggggctcaaggaaccaaggtgtccccacagtgagtggcactgtcaggtctaggatgggggtctcgggacccctggtcctggttctttccactgaattcagacacttgtatttgcctaagtatgagcaaaccacatacacatgtgcccatgtggccagggagaccagtgcgctgaagctgaggcccagagtacacctggcctgtgtcctgagtgttcacacacccaccaagcatccaggggcaactcctggtgcctcagccatcgggggctgtcccttccctgaggcccaggcccctccatctccctccaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccaggaagggggatggacacacgaagggggatggacacacgaagggggatggacacacgaagggggatggacacgaagggggatggacaccacgaagggggatggacacacgaagggggatggacac

SEQ ID NO: 316778 - DNA, 746 bp, Homo sapiens
gcagagaattgcttgaacccgggaggtggaggttgtagtgagccgagatcgcgccactgcactccagcctgggcaacagagtgagactccatctcaaaaaaacaaaacaaaaaaccaataagcccagaatcggccagaacccacaacccagtgagactgcgctgtgccaggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccaggcacagacctctgcagtgcagccataattgcactctgggctcacacacacacaccagccctttctttcg

SEQ ID NO: 316779 - DNA, 2402 bp, Homo sapiens
cgagtgcaacccccgacactaacggcctttacgcgacatccgagcagcgtgtctatcccaaaggcctaggagcatttgcccggctcggtcaaatctagcgcaagtttgaagcctgcggcctcgcaattttagcagcttcgttccaggccaggcttcctgaccacagcctcacctttgagcagctcagagccctgcctgccaggatgcgagccactgcctggatcgtggctctgcagggccacccatgatggaacaggtcgcctggtgaggtggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttcta

SEQ ID NO: 316780 - DNA, 2707 bp, Homo sapiens
ctctggatgcaaagtgtcgcagcacatgcctgcggacgggtgttcagtcactcaggcagcctttacaagagacctgtgaggaccaggctctgggactccacggtgaatgaggcagacacagccccatcctctgtgtcagtctgaggtgggtgtcagccatgtcattgtccaactctaccatcacaacttgggcttcgagcaggtggagacagtggtaagcggggagaggcaatagtgggcatctcactgggtgacctgggaggaccctgggcaggtgatggggaagctgaggctcacacatcctgcgggtggggacccagcctgaagaatgggctggtgtcacacagcattggagctgagactggggtctttagaatttcctaggtgggggcctgggaaccaacaggggctcaaggaaccaaggtgtccccacagtgagtggcactgtcaggtctaggatgggggtctcgggacccctggtcctggttctttccactgaattcagacacttgtatttgcctaagtatgagcaaaccacatacacatgtgcccatgtggccagggagaccagtgcgctgaagctgaggcccagagtacacctggcctgtgtcctgagtgttcacacacccaccaagcatccaggggcaactcctggtgcctcagccatcgggggctgtcccttccctgaggcccaggcccctccatctccctccaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggaggtgaggccctgcctgccagtccccctactcctctgctggccactgtgactgcagcatatgccctcagcatgtgtccctctctcccaccccagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttcta

SEQ ID NO: 316781 - DNA, 1950 bp, Homo sapiens
gacttcccagagccaggaatgttatggccaagggcaggaacagacagatggatccttagggacacagtggatagggagagctgccccaaagcctgggggccgagggagagagagtgtggtttgttcctcaggcacaggtaggaggttctcggaggtggctcttgagataggagcagcgtggaagggattgcacggtggggcctcgtgttggtgcgttcaaccctcagccaccccatggggcggggttctagagatgaggcctctggggccccgaggcagtgaagtgactcactgtgagtgcagctgggaagaggcagggcagggaattgatccaggtctatcatcctagagctgggatttccatcctcaactggcagagatgagagcctggagcattgcagatgccagggacttcacaaatgaaggcacagcatgggaaacctgcgtgggttccagggcagtccagcctgcaggggcccagggagtggtcagtaggcatttgtcacagccaaatgccagtggaaggagcagccgcccaggcagccctctactgatgagagtaacctcacccgtgcactagtttacagagcattcactgccccagcttatcccaggcctcccgcttccctctgcgggtggggtgctgagcaggcattattggcctgcatgttttactgatgaggaaactgaggctgggagagtctgtggtaggggtcaagcaggtccacagtggcggggcatggcagtggtggctgggcaggtccttgcagccttccctctccggcaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttcta

SEQ ID NO: 316782 - DNA, 1215 bp, Homo sapiens
atagggaaatttgccctcgaaggcccaaagaattcggcacgaggcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttcta

SEQ ID NO: 316783 - DNA, 706 bp, Homo sapiens
aagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccaggcacagacctctgcagtgcagccataattgcactctgggctcacacacacacaccagccctttctttcg

SEQ ID NO: 316784 - DNA, 1911 bp, Homo sapiens
agcgcgcgccgcggtcagctgactgctgggctggcacgtgacttgttctgtgttcgcttgggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttaccccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtg

SEQ ID NO: 316785 - DNA, 824 bp, Homo sapiens
agcgcgcgccgcggtcagctgactgctgggctggcacgtgacttgttctgtgttcgcttgggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagtaagtctttctattataaaaggttt

SEQ ID NO: 316786 - DNA, 1181 bp, Homo sapiens
tatgcgaatgaagactcggcctcccaatcagtctgatttgttgcagacagccaatttcccatctgccatgcaggaaaggtcaaaaggagtagcctctggtccttttgttacttaggcgtggaaagttagggttttcctttcaatttagttctaggaaaccggggtgaaacaaccttaggttccctgcctccagaccctatttcctgcctcagttctgctaccaacttgctgtgtgacctgggtgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgtaagtacttattagcccagtagagtaagaattgaagtgaatttcagaaaaaaaatgattgaaagaagatagacagaaaagggagggtaagtatgaaacttaatcattttttattactttgaggttctcaatttgttatgtaaacatagtaatttacattgtttaccctgttttatactaattatatctgtgttttgcttcttggcatttctacaagctagtaattatcttgctgtgtatcagatgtttatagctgcagaaatacagaaaccagtgatactagttatttacaaaaactataaattgcagagaggaagaaaataagcagttattttaattttatttggtagaagcgatagagtcaatagatgagtattttcaaggtaggttcatttttctaaaatggcgtagctgggcgtggtgggacatgttggtagtcccagcaactgaggaggctgaggcgggaggatcacttgagcccaggccttcgagaccaacctgggtaacatagtaagatcccatctgaa

SEQ ID NO: 316787 - DNA, 459 bp, Homo sapiens
tttcctatgtaccaggcactgtgctaaccacaggcttcatttaatcctcacaatacctgtgtaaggtattattaccaccactttgcatgtgaacaggctgaaattcagaggagtaaggtcacacaactagtaagtaggagagcctggattcaacacctggtatctattcccttgcgctgaacaactccgtgccctcactttcttcatctgtagatacctgttactgctgctacttcctcgtttgacaccttcctgggtcagtgagcgatggctctccccggatggggagtcctggtcaggccgaagcatgagctccggtcgctgcctgggagggacgcgggtgggtgcgggggcagagaccgtggcgttggagctggagctggctgggtggctgtgtctggtttctcggcgccaattcaccgtcttgggcctaggttccgtctctaaggaagagaagga

SEQ ID NO: 316788 - DNA, 6075 bp, Homo sapiens
agcgcgcgccgcggtcagctgactgctgggctggcacgtgacttgttctgtgttcgcttgggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttaccccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagctttagtcatttgttttgtctaagtctgtattttatgtgttgtcttcttaagatctataattttggcatttatgtcatttgtgacatagtctgaaaatagagacattgttggcctttaaaatctcagaaatgaatgacttaatttagtgtcctgaaagagcttttaaaagaggattttgtggcaatgtttctcttactacgtactcacaggtttgcaaatgggaaaaaagtttacatttcagtttaggggcatatctaagctatgctattccctttagaaaattagcctccaaaatcttttgtttcaaaatattatattatttcataaataatttcaagcaaatacagacatccacaatgtagaacatgagagaccccctccctcaatttccacctcccaagggaagtttatgtatttttctaggcccttttctatgtctttacatctctgtctcacacacacacacgtatacacacacacagtttatttttaataaaataggattataccacacacatcctgtcacttgcttttttgcttaagagtatatctaagagaatcctttgtgtcagtgaagctggagctacctcattcttttaactggctgcgtggcgttccattgagtgtctgtcatcatgtgtttagccgagtggatggatagtctgcttgtttttagtttttgctcttaacaaacactgctgcagtcagcatccttgcacagatttctttgtatacttgtattagtatttctgtaagatctgagaagtggaatttgtagggtcataggttatgtacacttaagtttttgacactcactgccaagtcatctgtcagaattctaaactaaagacatgtttggagtgtggatttatcttcagtttttctttggacaagaggaagctgtgaaagattttgctatcagaaaattttggttctttgtcttttgcacatgttctttgagtcttagtatctgtaacgtggcgctactctctctatcatgggggggcatgttttgacattaaattgacttttaagaaaaacatgtcactaacctgaagctcagccacacagtgacttttaaggttttatttagactttactgttgttctcatgagagtaggtacagactgcataaggtttagaatcccagcatatgtctgaaacgacgggactttcactgtgatttccaccagagaaattatagcagagtggctgagcatgtgctctgaggccaggccccagctctgctgctgacgagctgtgtggtcctgggcagagtggtctccgagttccagtccctcctctgtaaaatgggcatgattagagtgcccaccgcattagggatgttggggtgagtcagtgtgaccccacgtgcacagaaagtgctgcgagtggtgcatggtgagaggttgatgcaggtacttagcccttggggaacacaggtagttccttttcactgtgtttaacttcgggaaaatccagatccacatcattgtagagtctgagggttagaaggaagtcattgtgtctaacataacaacagagcagtttgtgtcactgagctccagtctgtgctggattattgatattgttggtggcggtcaccattcctggaaagggactgtcccaagccacttaccttcccgaggagtctgctggttctccttgaggatagtgcttagataacagactcattaaacatttactgagtgtctgtcagggatcattcacatccacatcatcctcccggcccctccccgtgttgttcatggagggagtactggcggtccccattttcatgtatggagacttcaggtgaaagaagttaagtgaattctttgttgagtcacaaatcttgagccagtcagaatttgaacctaagatttttgactgctggttgtcacacttcccgccccacactcaactgttgtgtgaatgagccagacacattgcttaacctgagtccgagatggacaatggtataggaaagatattcggtatggagaatcagatgttaacttgtgttgctatttttgttttgttttgttttgttttgtttttgagacaaggtcttgctctgtcacccaggctagagtgcagtggcatgatcagggcttactgcagcctcaccctcgatttcctgggctcaagcaatcctcccacctcagcccccaagtagctgggcctacaggtgcgtgctaccacgcctggccaattttttaaattttagcacagatgaggtctcactatgttgcccgggctggtctcgaactcctgagctcaagggatcctcccgcctcagcctcccaaagtgctggtgttacaggcataagccaccacgcctggcctgtgttgctattatatttggcaggaacccagagtccagaacatttcatctatgatgggttagataatgtgtctagttgtttgcatgccaatttcagtagcctcagttattcaacctaggagatttttctacctctttactaccctgctgaagttgctcttcagcagaaaatctttgtggaacacattccacactttgaaatcttcgtggaacaaaagatatttgtggaaccaatctttgtggaacatattccagctttttgaatgagtgcatatccagtagtacctttaaagtaacactttgtacataacaaatactcagcaaatgtgaaactttatttgctcttacttcaaaattagtccaaaatgttggaaataaaatataagacattgatctagatatgaggtttttctccttcattctcagctgtcgaagaaatcaaagtagcatatgcacaaggttaaaaaccacatatacaaatactatagaacagcttataatgaaaaccttgcctgcctttataaaaaatgtgattatcttcttctgttaatgtcaataaaagatggtttgtcctagaaggtctataaatggtattatgttctggaggaaacctagcaaaaactttgctagtttagtacttgtctctaaattgatgttcacccatttcaatattgcacttattaatggtctttatttttctagcatagataacaattgattctttagattcatatatggaggtaattcttgctttctaaagaaaggaatatggcacattggaaccattttattcaccagtggatttacccttagagtatttttagatctgagctgatgacttgtgagagaaaaagggaacagagtaaagccatggaagccatgaacagtaagagactgccgcctggcatggtttcttcttctgcagaagatgaaactgaggagaaacaagacaacatccttcataccaggaatggtcaagataatgcaagaagaaaaaagctttcaaacaaatcagaaggcagtcaacaaacagaaagggggacattccttccctggcagttactcaaaactgaaattgcttattgtgtacaccggggcttgtacttggggaatttaataaaaatgctcattaccaagctaaaaaaaaaaaaaaaaaaaaaaaaaaaaaaaaaaaaaagagaaaagaaagaaggaggggagagaacaccaaaaagggcccaaagggggcgccaagcacaagtccaaggaggggggcaccaagggggccccgtagagaaaatggccaggcagacatgtgaccaaacttaaaaaccgagacaagacggggaaacaggggccaccacgcggagcaacaatgcaaaagggccactgcatcgagagacgggggggacacaaatgggcaccaaagaaaccctcagagaactagaggccaataaaaaattaaaaaagctccaagggagcaacaggtcaaaacaaccggcccaagaacagctcgaaagactggctagcgagagaaacttaaaagttagcg

SEQ ID NO: 316789 - DNA, 2370 bp, Homo sapiens
agcgcgcgccgcggtcagctgactgctgggctggcacgtgacttgttctgtgttcgcttgggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttaccccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagctttaaaaaaaaaaaaaaacaccaaagataacagacgagcacaccccaagaaaacacaaacaaaaaaagagggggggggggggaaattatcaggggggaggcgaacgccctttttgaaaggcccacgggggtaaaagggggggcaaaacggggggacacggtgtgagcccctgg

SEQ ID NO: 316790 - DNA, 6021 bp, Homo sapiens
agcgcgcgccgcggtcagctgactgctgggctggcacgtgacttgttctgtgttcgcttgggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttaccccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagctttagtcatttgttttgtctaagtctgtattttatgtgttgtcttcttaagatctataattttggcatttatgtcatttgtgacatagtctgaaaatagagacattgttggcctttaaaatctcagaaatgaatgacttaatttagtgtcctgaaagagcttttaaaagaggattttgtggcaatgtttctcttactacgtactcacaggtttgcaaatgggaaaaaagtttacatttcagtttaggggcatatctaagctatgctattccctttagaaaattagcctccaaaatcttttgtttcaaaatattatattatttcataaataatttcaagcaaatacagacatccacaatgtagaacatgagagaccccctccctcaatttccacctcccaagggaagtttatgtatttttctaggcccttttctatgtctttacatctctgtctcacacacacacacgtatacacacacacagtttatttttaataaaataggattataccacacacatcctgtcacttgcttttttgcttaagagtatatctaagagaatcctttgtgtcagtgaagctggagctacctcattcttttaactggctgcgtggcgttccattgagtgtctgtcatcatgtgtttagccgagtggatggatagtctgcttgtttttagtttttgctcttaacaaacactgctgcagtcagcatccttgcacagatttctttgtatacttgtattagtatttctgtaagatctgagaagtggaatttgtagggtcataggttatgtacacttaagtttttgacactcactgccaagtcatctgtcagaattctaaactaaagacatgtttggagtgtggatttatcttcagtttttctttggacaagaggaagctgtgaaagattttgctatcagaaaattttggttctttgtcttttgcacatgttctttgagtcttagtatctgtaacgtggcgctactctctctatcatgggggggcatgttttgacattaaattgacttttaagaaaaacatgtcactaacctgaagctcagccacacagtgacttttaaggttttatttagactttactgttgttctcatgagagtaggtacagactgcataaggtttagaatcccagcatatgtctgaaacgacgggactttcactgtgatttccaccagagaaattatagcagagtggctgagcatgtgctctgaggccaggccccagctctgctgctgacgagctgtgtggtcctgggcagagtggtctccgagttccagtccctcctctgtaaaatgggcatgattagagtgcccaccgcattagggatgttggggtgagtcagtgtgaccccacgtgcacagaaagtgctgcgagtggtgcatggtgagaggttgatgcaggtacttagcccttggggaacacaggtagttccttttcactgtgtttaacttcgggaaaatccagatccacatcattgtagagtctgagggttagaaggaagtcattgtgtctaacataacaacagagcagtttgtgtcactgagctccagtctgtgctggattattgatattgttggtggcggtcaccattcctggaaagggactgtcccaagccacttaccttcccgaggagtctgctggttctccttgaggatagtgcttagataacagactcattaaacatttactgagtgtctgtcagggatcattcacatccacatcatcctcccggcccctccccgtgttgttcatggagggagtactggcggtccccattttcatgtatggagacttcaggtgaaagaagttaagtgaattctttgttgagtcacaaatcttgagccagtcagaatttgaacctaagatttttgactgctggttgtcacacttcccgccccacactcaactgttgtgtgaatgagccagacacattgcttaacctgagtccgagatggacaatggtataggaaagatattcggtatggagaatcagatgttaacttgtgttgctatttttgttttgttttgttttgttttgtttttgagacaaggtcttgctctgtcacccaggctagagtgcagtggcatgatcagggcttactgcagcctcaccctcgatttcctgggctcaagcaatcctcccacctcagcccccaagtagctgggcctacaggtgcgtgctaccacgcctggccaattttttaaattttagcacagatgaggtctcactatgttgcccgggctggtctcgaactcctgagctcaagggatcctcccgcctcagcctcccaaagtgctggtgttacaggcataagccaccacgcctggcctgtgttgctattatatttggcaggaacccagagtccagaacatttcatctatgatgggttagataatgtgtctagttgtttgcatgccaatttcagtagcctcagttattcaacctaggagatttttctacctctttactaccctgctgaagttgctcttcagcagaaaatctttgtggaacacattccacactttgaaatcttcgtggaacaaaagatatttgtggaaccaatctttgtggaacatattccagctttttgaatgagtgcatatccagtagtacctttaaagtaacactttgtacataacaaatactcagcaaatgtgaaactttatttgctcttacttcaaaattagtccaaaatgttggaaataaaatataagacattgatctagatatgaggtttttctccttcattctcagctgtcgaagaaatcaaagtagcatatgcacaaggttaaaaaccacatatacaaatactatagaacagcttataatgaaaaccttgcctgcctttataaaaaatgtgattatcttcttctgttaatgtcaataaaagatggtttgtcctagaaggtctataaatggtattatgttctggaggaaacctagcaaaaactttgctagtttagtacttgtctctaaattgatgttcacccatttcaatattgcacttattaatggtctttatttttctagcatagataacaattgattctttagattcatatatggaggtaattcttgctttctaaagaaaggaatatggcacattggaaccattttattcaccagtggatttacccttagagtatttttagatctgagctgatgacttgtgagagaaaaagggaacagagtaaagccatggaagccatgaacagtaagagactgccgcctggcatggtttcttcttctgcagaagatgaaactgaggagaaacaagacaacatccttcataccaggaatggtcaagataatgcaagaagaaaaaagctttcaaacaaatcagaaggcagtcaacaaacagaaagggggacattccttccctggcagttactcaaaactgaaattgcttattgtgtacaccggggcttgtacttggggaatttaataaaaatgctcattaccaagctaaaaaaaaaaaaaaaaaaaaaaaaaaaaaaaaaaaaaagagaaaagaaagaaggaggggagagaacaccaaaaagggcccaaagggggcgccaagcacaagtccaaggaggggggcaccaagggggccccgtagagaaaatggccaggcagacatgtgaccaaacttaaaaaccgagacaagacggggaaacaggggccaccacgcggagcaacaatgcaaaagggccactgcatcgagagacgggggggacacaaatgggcaccaaagaaaccctcagagaactagaggccaataaaaaattaaaaaagctccaagggagcaacaggtcaaaacaaccggcccaagaacagctcgaaagactggctagcgagagaaacttaaaagttagcg

SEQ ID NO: 316791 - DNA, 4998 bp, Homo sapiens
gcacgagcctatgtgtactattcttgttgactcaggtttaaacctggaatatccataggagcctatggaaaaaacagacaattattcaattttgtatttacagaactcaaaaaaagaaagcaagtattaacatttacctttttattgaacatctactctgggctaaatgtatgcacttaaggctaatttatctgagttagacattattcccattttgcaaatgagaagacaatctctgaaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttaccccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagctttagtcatttgttttgtctaagtctgtattttatgtgttgtcttcttaagatctataattttggcatttatgtcatttgtgacatagtctgaaaatagagacattgttggcctttaaaatctcagaaatgaatgacttaatttagtgtcctgaaagagcttttaaaagaggattttgtggcaatgtttctcttactacgtactcacaggtttgcaaatgggaaaaaagtttacatttcagtttaggggcatatctaagctatgctattccctttagaaaattagcctccaaaatcttttgtttcaaaatattatattatttcataaataatttcaagcaaatacagacatccacaatgtagaacatgagagaccccctccctcaatttccacctcccaagggaagtttatgtatttttctaggcccttttctatgtctttacatctctgtctcacacacacacacgtatacacacacacagtttatttttaataaaataggattataccacacacatcctgtcacttgcttttttgcttaagagtatatctaagagaatcctttgtgtcagtgaagctggagctacctcattcttttaactggctgcgtggcgttccattgagtgtctgtcatcatgtgtttagccgagtggatggatagtctgcttgtttttagtttttgctcttaacaaacactgctgcagtcagcatccttgcacagatttctttgtatacttgtattagtatttctgtaagatctgagaagtggaatttgtagggtcataggttatgtacacttaagtttttgacactcactgccaagtcatctgtcagaattctaaactaaagacatgtttggagtgtggatttatcttcagtttttctttggacaagaggaagctgtgaaagattttgctatcagaaaattttggttctttgtcttttgcacatgttctttgagtcttagtatctgtaacgtggcgctactctctctatcatgggggggcatgttttgacattaaattgacttttaagaaaaacatgtcactaacctgaagctcagccacacagtgacttttaaggttttatttagactttactgttgttctcatgagagtaggtacagactgcataaggtttagaatcccagcatatgtctgaaacgacgggactttcactgtgatttccaccagagaaattatagcagagtggctgagcatgtgctctgaggccaggccccagctctgctgctgacgagctgtgtggtcctgggcagagtggtctccgagttccagtccctcctctgtaaaatgggcatgattagagtgcccaccgcattagggatgttggggtgagtcagtgtgaccccacgtgcacagaaagtgctgcgagtggtgcatggtgagaggttgatgcaggtacttagcccttggggaacacaggtagttccttttcactgtgtttaacttcgggaaaatccagatccacatcattgtagagtctgagggttagaaggaagtcattgtgtctaacataacaacagagcagtttgtgtcactgagctccagtctgtgctggattattgatattgttggtggcggtcaccattcctggaaagggactgtcccaagccacttaccttcccgaggagtctgctggttctccttgaggatagtgcttagataacagactcattaaacatttactgagtgtctgtcagggatcattcacatccacatcatcctcccggcccctccccgtgttgttcatggagggagtactggcggtccccattttcatgtatggagacttcaggtgaaagaagttaagtgaattctttgttgagtcacaaatcttgagccagtcagaatttgaacctaagatttttgactgctggttgtcacacttcccgccccacactcaactgttgtgtgaatgagccagacacattgcttaacctgagtccgagatggacaatggtataggaaagatattcggtatggagaatcagatgttaacttgtgttgctatttttgttttgttttgttttgttttgtttttgagacaaggtcttgctctgtcacccaggctagagtgcagtggcatgatcagggcttactgcagcctcaccctcgatttcctgggctcaagcaatcctcccacctcagcccccaagtagctgggcctacaggtgcgtgctaccacgcctggccaattttttaaattttagcacagatgaggtctcactatgttgcccgggctggtctcgaactcctgagctcaagggatcctcccgcctcagcctcccaaagtgctggtgttacaggcataagccaccacgcctggcctgtgttgctattatatttggcaggaacccagagtccagaacatttcatctatgatgggttagataatgtgtctagttgtttgcatgccaatttcagtagcctcagttattcaacctaggagatttttctacctctttactaccctgctgaagttgctcttcagcagaaaatctttgtggaacacattccacactttgaaatcttcgtggaacaaaagatatttgtggaaccaatctttgtggaacatattccagctttttgaatgagtgcatatccagtagtacctttaaagtaacactttgtacataacaaatactcagcaaatgtgaaactttatttgctcttacttcaaaattagtccaaaatgttggaaataaaatataagacattgatctagatatgaggtttttctccttcattctcagctgtcgaagaaatcaaagtagcatatgcacaaggttaaaaaccacatatacaaatactatagaacagcttataatgaaaaccttgcctgcctttataaaaaatgtgattatcttcttctgttaatgtcaataaaagatggtttgtcctagaaggtctataaatggtattatgttctggaggaaacctagcaaaaactttgctagtttagtacttgtctctaaattgatgttcacccatttcaatattgcacttattaatggtctttatttttctagcatagataacaattgattctttagattcatatatggaggtaattcttgctttctaaagaaaggaatatggcacattggaaccattttattcaccagtggatttacccttagagtatttttagatctgagctgatgacttgtgagagaaaaagggaacagagtaaagccatggaagccatgaacagtaagagactgccgcctggcatggtttcttcttctgcagaagatgaaactgaggagaaacaagacaacatccttcataccaggaatggtcaagataatgcaagaagaaaaaagctttcaaacaaatcagaaggcagtcaacaaacagaaagggggacattccttccctggcagttactcaaaactgaaattgcttattgtgtacaccggggcttgtacttggggaatttaataaaaatgctcattaccaagctaaaaaaaaaaaaaaaaaaaaaaaaaaaaaaaaaaaaaagagaaaagaaagaaggaggggagagaacaccaaaaagggcccaaagggggcgccaagcacaagtccaaggaggggggcaccaagggggccccgtagagaaaatggccaggcagacatgtgaccaaacttaaaaaccgagacaagacggggaaacaggggccaccacgcggagcaacaatgcaaaagggccactgcatcgagagacgggggggacacaaatgggcaccaaagaaaccctcagagaactagaggccaataaaaaattaaaaaagctccaagggagcaacaggtcaaaacaaccggcccaagaacagctcgaaagactggctagcgagagaaacttaaaagttagcg

SEQ ID NO: 316792 - DNA, 1806 bp, Homo sapiens
agcgcgcgccgcggtcagctgactgctgggctggcacgtgacttgttctgtgttcgcttgggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgtaagtacttattagcccagtagagtaagaattgaagtgaatttcagaaaaaaaatgattgaaagaagatagacagaaaagggagggtaagtatgaaacttaatcattttttattactttgaggttctcaatttgttatgtaaacatagtaatttacattgtttaccctgttttatactaattatatctgtgttttgcttcttggcatttctacaagctagtaattatcttgctgtgtatcagatgtttatagctgcagaaatacagaaaccagtgatactagttatttacaaaaactataaattgcagagaggaagaaaataagcagttattttaattttatttggtagaagcgatagagtcaatagatgagtattttcaaggtaggttcatttttctaaaatggcgtagctgggcgtggtgggacatgttggtagtcccagcaactgaggaggctgaggcgggaggatcacttgagcccaggccttcgagaccaacctgggtaacatagtaagatcccatctgaa

SEQ ID NO: 316793 - DNA, 182 bp, Homo sapiens
aaaacctgtcagcaaacatgggagaaattgcatgcggcaacttcaaagaacaataatcttgctgtcacttccaagttcaatattcctgacttaaaggtgaagctgcactgtgcaaaattatatatgagttcatcatccaggggagggccagttctctcttttagtggaaatgagatacccag

SEQ ID NO: 316794 - DNA, 2201 bp, Homo sapiens
agcgcgcgccgcggtcagctgactgctgggctggcacgtgacttgttctgtgttcgcttgggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttaccccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagcttta

SEQ ID NO: 316795 - DNA, 4809 bp, Homo sapiens
  misc_feature (4809)..(4809): n is a, c, g, or t
agcgcgcgccgcggtcagctgactgctgggctggcacgtgacttgttctgtgttcgcttgggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttaccccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagctttagtcatttgttttgtctaagtctgtattttatgtgttgtcttcttaagatctataattttggcatttatgtcatttgtgacatagtctgaaaatagagacattgttggcctttaaaatctcagaaatgaatgacttaatttagtgtcctgaaagagcttttaaaagaggattttgtggcaatgtttctcttactacgtactcacaggtttgcaaatgggaaaaaagtttacatttcagtttaggggcatatctaagctatgctattccctttagaaaattagcctccaaaatcttttgtttcaaaatattatattatttcataaataatttcaagcaaatacagacatccacaatgtagaacatgagagaccccctccctcaatttccacctcccaagggaagtttatgtatttttctaggcccttttctatgtctttacatctctgtctcacacacacacacgtatacacacacacagtttatttttaataaaataggattataccacacacatcctgtcacttgcttttttgcttaagagtatatctaagagaatcctttgtgtcagtgaagctggagctacctcattcttttaactggctgcgtggcgttccattgagtgtctgtcatcatgtgtttagccgagtggatggatagtctgcttgtttttagtttttgctcttaacaaacactgctgcagtcagcatccttgcacagatttctttgtatacttgtattagtatttctgtaagatctgagaagtggaatttgtagggtcataggttatgtacacttaagtttttgacactcactgccaagtcatctgtcagaattctaaactaaagacatgtttggagtgtggatttatcttcagtttttctttggacaagaggaagctgtgaaagattttgctatcagaaaattttggttctttgtcttttgcacatgttctttgagtcttagtatctgtaacgtggcgctactctctctatcatgggggggcatgttttgacattaaattgacttttaagaaaaacatgtcactaacctgaagctcagccacacagtgacttttaaggttttatttagactttactgttgttctcatgagagtaggtacagactgcataaggtttagaatcccagcatatgtctgaaacgacgggactttcactgtgatttccaccagagaaattatagcagagtggctgagcatgtgctctgaggccaggccccagctctgctgctgacgagctgtgtggtcctgggcagagtggtctccgagttccagtccctcctctgtaaaatgggcatgattagagtgcccaccgcattagggatgttggggtgagtcagtgtgaccccacgtgcacagaaagtgctgcgagtggtgcatggtgagaggttgatgcaggtacttagcccttggggaacacaggtagttccttttcactgtgtttaacttcgggaaaatccagatccacatcattgtagagtctgagggttagaaggaagtcattgtgtctaacataacaacagagcagtttgtgtcactgagctccagtctgtgctggattattgatattgttggtggcggtcaccattcctggaaagggactgtcccaagccacttaccttcccgaggagtctgctggttctccttgaggatagtgcttagataacagactcattaaacatttactgagtgtctgtcagggatcattcacatccacatcatcctcccggcccctccccgtgttgttcatggagggagtactggcggtccccattttcatgtatggagacttcaggtgaaagaagttaagtgaattctttgttgagtcacaaatcttgagccagtcagaatttgaacctaagatttttgactgctggttgtcacacttcccgccccacactcaactgttgtgtgaatgagccagacacattgcttaacctgagtccgagatggacaatggtataggaaagatattcggtatggagaatcagatgttaacttgtgttgctatttttgttttgttttgttttgttttgtttttgagacaaggtcttgctctgtcacccaggctagagtgcagtggcatgatcagggcttactgcagcctcaccctcgatttcctgggctcaagcaatcctcccacctcagcccccaagtagctgggcctacaggtgcgtgctaccacgcctggccaattttttaaattttagcacagatgaggtctcactatgttgcccgggctggtctcgaactcctgagctcaagggatcctcccgcctcagcctcccaaagtgctggtgttacaggcataagcacagcggcggtgctatatattggcagaaccagattcagacattcaccatgatggtgaaaggccatgttgctgcacttcgggcccctattaccaggaaatttacccttatacgctgaatgcgctcacaatgtggggacttcactgtacttgggcaaaattgggccctgtggaataccccgagagacacccaaaatcaacccagtgaatgttcccacagggaaaaaaatggtccacagtgacatcaactacgtcactcaccactctaccacacttctcgn

SEQ ID NO: 316796 - DNA, 6034 bp, Homo sapiens
agcgcgcgccgcggtcagctgactgctgggctggcacgtgacttgttctgtgttcgcttgggtagaggaagccgtgaggccggagcttaggtcgggaagggatggatcgctgagccgatagcgtccgctaggctgtctgcctcggtaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttaccccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagctttagtcatttgttttgtctaagtctgtattttatgtgttgtcttcttaagatctataattttggcatttatgtcatttgtgacatagtctgaaaatagagacattgttggcctttaaaatctcagaaatgaatgacttaatttagtgtcctgaaagagcttttaaaagaggattttgtggcaatgtttctcttactacgtactcacaggtttgcaaatgggaaaaaagtttacatttcagtttaggggcatatctaagctatgctattccctttagaaaattagcctccaaaatcttttgtttcaaaatattatattatttcataaataatttcaagcaaatacagacatccacaatgtagaacatgagagaccccctccctcaatttccacctcccaagggaagtttatgtatttttctaggcccttttctatgtctttacatctctgtctcacacacacacacgtatacacacacacagtttatttttaataaaataggattataccacacacatcctgtcacttgcttttttgcttaagagtatatctaagagaatcctttgtgtcagtgaagctggagctacctcattcttttaactggctgcgtggcgttccattgagtgtctgtcatcatgtgtttagccgagtggatggatagtctgcttgtttttagtttttgctcttaacaaacactgctgcagtcagcatccttgcacagatttctttgtatacttgtattagtatttctgtaagatctgagaagtggaatttgtagggtcataggttatgtacacttaagtttttgacactcactgccaagtcatctgtcagaattctaaactaaagacatgtttggagtgtggatttatcttcagtttttctttggacaagaggaagctgtgaaagattttgctatcagaaaattttggttctttgtcttttgcacatgttctttgagtcttagtatctgtaacgtggcgctactctctctatcatgggggggcatgttttgacattaaattgacttttaagaaaaacatgtcactaacctgaagctcagccacacagtgacttttaaggttttatttagactttactgttgttctcatgagagtaggtacagactgcataaggtttagaatcccagcatatgtctgaaacgacgggactttcactgtgatttccaccagagaaattatagcagagtggctgagcatgtgctctgaggccaggccccagctctgctgctgacgagctgtgtggtcctgggcagagtggtctccgagttccagtccctcctctgtaaaatgggcatgattagagtgcccaccgcattagggatgttggggtgagtcagtgtgaccccacgtgcacagaaagtgctgcgagtggtgcatggtgagaggttgatgcaggtacttagcccttggggaacacaggtagttccttttcactgtgtttaacttcgggaaaatccagatccacatcattgtagagtctgagggttagaaggaagtcattgtgtctaacataacaacagagcagtttgtgtcactgagctccagtctgtgctggattattgatattgttggtggcggtcaccattcctggaaagggactgtcccaagccacttaccttcccgaggagtctgctggttctccttgaggatagtgcttagataacagactcattaaacatttactgagtgtctgtcagggatcattcacatccacatcatcctcccggcccctccccgtgttgttcatggagggagtactggcggtccccattttcatgtatggagacttcaggtgaaagaagttaagtgaattctttgttgagtcacaaatcttgagccagtcagaatttgaacctaagatttttgactgctggttgtcacacttcccgccccacactcaactgttgtgtgaatgagccagacacattgcttaacctgagtccgagatggacaatggtataggaaagatattcggtatggagaatcagatgttaacttgtgttgctatttttgttttgttttgttttgttttgtttttgagacaaggtcttgctctgtcacccaggctagagtgcagtggcatgatcagggcttactgcagcctcaccctcgatttcctgggctcaagcaatcctcccacctcagcccccaagtagctgggcctacaggtgcgtgctaccacgcctggccaattttttaaattttagcacagatgaggtctcactatgttgcccgggctggtctcgaactcctgagctcaagggatcctcccgcctcagcctcccaaagtgctggtgttacaggcataagccaccacgcctggcctgtgttgctattatatttggcaggaacccagagtccagaacatttcatctatgatgggttagataatgtgtctagttgtttgcatgccaatttcagtagcctcagttattcaacctaggagatttttctacctctttactaccctgctgaagttgctcttcagcagaaaatctttgtggaacacattccacactttgaaatcttcgtggaacaaaagatatttgtggaaccaatctttgtggaacatattccagctttttgaatgagtgcatatccagtagtacctttaaagtaacactttgtacataacaaatactcagcaaatgtgaaactttatttgctcttacttcaaaattagtccaaaatgttggaaataaaatataagacattgatctagatatgaggtttttctccttcattctcagctgtcgaagaaatcaaagtagcatatgcacaaggttaaaaaccacatatacaaatactatagaacagcttataatgaaaaccttgcctgcctttataaaaaatgtgattatcttcttctgttaatgtcaataaaagatggtttgtcctagaaggtctataaatggtattatgttctggaggaaacctagcaaaaactttgctagtttagtacttgtctctaaattgatgttcacccatttcaatattgcacttattaatggtctttatttttctagcatagataacaattgattctttagattcatatatggaggtaattcttgctttctaaagaaaggaatatggcacattggaaccattttattcaccagtggatttacccttagagtatttttagatctgagctgatgacttgtgagagaaaaagggaacagagtaaagccatggaagccatgaacagtaagagactgccgcctggcatggtttcttcttctgcagaagatgaaactgaggagaaacaagacaacatccttcataccaggaatggtcaagataatgcaagaagaaaaaagctttcaaacaaatcagaaggcagtcaacaaacagaaagggggacattccttccctggcagttactcaaaactgaaattgcttattgtgtacaccggggcttgtacttggggaatttaataaaaatgctcattaccaagctaaaaaaaaaaaaaaaaaaaaaaaaaaaaaaaaaaaaaagagaaaagaaagaaggaggggagagaacaccaaaaagggcccaaagggggcgccaagcacaagtccaaggaggggggcaccaagggggccccgtagagaaaatggccaggcagacatgtgaccaaacttaaaaaccgagacaagacggggaaacaggggccaccacgcggagcaacaatgcaaaagggccactgcatcgagagacgggggggacacaaatgggcaccaaagaaaccctcagagaactagaggccaataaaaaattaaaaaagctccaagggagcaacaggtcaaaacaaccggcccaagaacagctcgaaagactggctagcgagagaaacttaaaagttagcg

SEQ ID NO: 316797 - DNA, 6021 bp, Homo sapiens
agcgcgcgccgcggtcagctgactgctgggctggcacgtgacttgttctgtgttcgcttgggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttaccccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagctttagtcatttgttttgtctaagtctgtattttatgtgttgtcttcttaagatctataattttggcatttatgtcatttgtgacatagtctgaaaatagagacattgttggcctttaaaatctcagaaatgaatgacttaatttagtgtcctgaaagagcttttaaaagaggattttgtggcaatgtttctcttactacgtactcacaggtttgcaaatgggaaaaaagtttacatttcagtttaggggcatatctaagctatgctattccctttagaaaattagcctccaaaatcttttgtttcaaaatattatattatttcataaataatttcaagcaaatacagacatccacaatgtagaacatgagagaccccctccctcaatttccacctcccaagggaagtttatgtatttttctaggcccttttctatgtctttacatctctgtctcacacacacacacgtatacacacacacagtttatttttaataaaataggattataccacacacatcctgtcacttgcttttttgcttaagagtatatctaagagaatcctttgtgtcagtgaagctggagctacctcattcttttaactggctgcgtggcgttccattgagtgtctgtcatcatgtgtttagccgagtggatggatagtctgcttgtttttagtttttgctcttaacaaacactgctgcagtcagcatccttgcacagatttctttgtatacttgtattagtatttctgtaagatctgagaagtggaatttgtagggtcataggttatgtacacttaagtttttgacactcactgccaagtcatctgtcagaattctaaactaaagacatgtttggagtgtggatttatcttcagtttttctttggacaagaggaagctgtgaaagattttgctatcagaaaattttggttctttgtcttttgcacatgttctttgagtcttagtatctgtaacgtggcgctactctctctatcatgggggggcatgttttgacattaaattgacttttaagaaaaacatgtcactaacctgaagctcagccacacagtgacttttaaggttttatttagactttactgttgttctcatgagagtaggtacagactgcataaggtttagaatcccagcatatgtctgaaacgacgggactttcactgtgatttccaccagagaaattatagcagagtggctgagcatgtgctctgaggccaggccccagctctgctgctgacgagctgtgtggtcctgggcagagtggtctccgagttccagtccctcctctgtaaaatgggcatgattagagtgcccaccgcattagggatgttggggtgagtcagtgtgaccccacgtgcacagaaagtgctgcgagtggtgcatggtgagaggttgatgcaggtacttagcccttggggaacacaggtagttccttttcactgtgtttaacttcgggaaaatccagatccacatcattgtagagtctgagggttagaaggaagtcattgtgtctaacataacaacagagcagtttgtgtcactgagctccagtctgtgctggattattgatattgttggtggcggtcaccattcctggaaagggactgtcccaagccacttaccttcccgaggagtctgctggttctccttgaggatagtgcttagataacagactcattaaacatttactgagtgtctgtcagggatcattcacatccacatcatcctcccggcccctccccgtgttgttcatggagggagtactggcggtccccattttcatgtatggagacttcaggtgaaagaagttaagtgaattctttgttgagtcacaaatcttgagccagtcagaatttgaacctaagatttttgactgctggttgtcacacttcccgccccacactcaactgttgtgtgaatgagccagacacattgcttaacctgagtccgagatggacaatggtataggaaagatattcggtatggagaatcagatgttaacttgtgttgctatttttgttttgttttgttttgttttgtttttgagacaaggtcttgctctgtcacccaggctagagtgcagtggcatgatcagggcttactgcagcctcaccctcgatttcctgggctcaagcaatcctcccacctcagcccccaagtagctgggcctacaggtgcgtgctaccacgcctggccaattttttaaattttagcacagatgaggtctcactatgttgcccgggctggtctcgaactcctgagctcaagggatcctcccgcctcagcctcccaaagtgctggtgttacaggcataagccaccacgcctggcctgtgttgctattatatttggcaggaacccagagtccagaacatttcatctatgatgggttagataatgtgtctagttgtttgcatgccaatttcagtagcctcagttattcaacctaggagatttttctacctctttactaccctgctgaagttgctcttcagcagaaaatctttgtggaacacattccacactttgaaatcttcgtggaacaaaagatatttgtggaaccaatctttgtggaacatattccagctttttgaatgagtgcatatccagtagtacctttaaagtaacactttgtacataacaaatactcagcaaatgtgaaactttatttgctcttacttcaaaattagtccaaaatgttggaaataaaatataagacattgatctagatatgaggtttttctccttcattctcagctgtcgaagaaatcaaagtagcatatgcacaaggttaaaaaccacatatacaaatactatagaacagcttataatgaaaaccttgcctgcctttataaaaaatgtgattatcttcttctgttaatgtcaataaaagatggtttgtcctagaaggtctataaatggtattatgttctggaggaaacctagcaaaaactttgctagtttagtacttgtctctaaattgatgttcacccatttcaatattgcacttattaatggtctttatttttctagcatagataacaattgattctttagattcatatatggaggtaattcttgctttctaaagaaaggaatatggcacattggaaccattttattcaccagtggatttacccttagagtatttttagatctgagctgatgacttgtgagagaaaaagggaacagagtaaagccatggaagccatgaacagtaagagactgccgcctggcatggtttcttcttctgcagaagatgaaactgaggagaaacaagacaacatccttcataccaggaatggtcaagataatgcaagaagaaaaaagctttcaaacaaatcagaaggcagtcaacaaacagaaagggggacattccttccctggcagttactcaaaactgaaattgcttattgtgtacaccggggcttgtacttggggaatttaataaaaatgctcattaccaagctaaaaaaaaaaaaaaaaaaaaaaaaaaaaaaaaaaaaaagagaaaagaaagaaggaggggagagaacaccaaaaagggcccaaagggggcgccaagcacaagtccaaggaggggggcaccaagggggccccgtagagaaaatggccaggcagacatgtgaccaaacttaaaaaccgagacaagacggggaaacaggggccaccacgcggagcaacaatgcaaaagggccactgcatcgagagacgggggggacacaaatgggcaccaaagaaaccctcagagaactagaggccaataaaaaattaaaaaagctccaagggagcaacaggtcaaaacaaccggcccaagaacagctcgaaagactggctagcgagagaaacttaaaagttagcg

SEQ ID NO: 316798 - DNA, 322 bp, Homo sapiens
accctatttcaaaaaaataaaaaataataattaatttaaaaaaaaaagacacagaacagtaatgtgtctattctctataaatcaaatagattatgaatcccaaggtcaaggatttaagcaaactcctaggacctgaacctcaaagtaatcattagaaaatcactagacttcaggccagacatggtggctcatgactgtaatctcagcactttgggaggctgtggtgagaggattggttgagactgggagttccaggctgcagtgagcagcaatcacaccactgcattccccccgggagacagtgagaccctgtctcagaaaa

SEQ ID NO: 316799 - DNA, 2719 bp, Homo sapiens
tctcgagacagagtctcgctctgtagcccaggctggagaacagtggcgcgatctcggctcactgcaacctccgcctcctgggtccaagagattctcctgcctcagcctcccgagtagctgggattacaggcgcgcgccaccccgcccggctaagtttttgtatttttagtagagacgggtggggggaggggggagggggtcaccatgttggccaggctactctcgaaatcgtgacctcgtgatccgcccgcctcggccttccaaagtgctaggattacaggcgtgagccaccactcccggccctgggtgctggttttcttcacctccgagtgaacagcagagggggctgttgggtgagggccagaagagttggggaggcacgagggcgtccagcgctgccctcactcaagatggcggccagagcctcgcgcttggtcgcgtggggcggtgcgtgagtgcttagctcacaggctccgggaccgcgctcgggggcggagcggatagtgggaaggggacgcgcgccctgcggcccggcctctagtcatcgccctcgcagcggcggccaacatcaccgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcggaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggacccaactgggagacaaattggactcgttcattaaaccacctgagtgcagtagtgatgtcaaccttgagctccggcagcggaacagaggggacctgacagcggactcggtccagaggggttcccgccatggcctagagcagtacctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagagcttttgtttgcaaatacttgtccatatttgctccatttcttactttacaacttgcgtacatgggattatacaaatattttcccaagagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacaaaaaaaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatgaaagaaactgaattgtctaatgttaactctgcacattgtaacttttcttgttgagttagtatcttaatttttactccagcacaagtatttaatcaaagaaaagattcatacatgtgaaattggaaggtatttataaaatttttattgctgtataccaaactcagaattggaactttttacatttgagtttcactttttagaagtatgttttaagcaagcaaaaacaaaatgggatgtgaagaattgaggcatgcaacccaatagcataaatgtcctttttccccccaaatatggtctagatgagttattataaacattgtttttatttttttgagacagagtttcgctcttgttgcccaggctagagtgcaatggcgccatctcggctcaccgcaacctccaccttcctggttcaagggattctcctgcctcagcctcccaagtagctgggattacaggcatgcaccaccacgcccagctaatttttatattctttagtaaagacagggtttctccatgttggtcaggctggtctcgaacttctgacctcaggtgatctgcccacctcggcctcccaaagtgctgggattacaggcgtgagccactgcacctggccttataaatatccttttaactaactcagtaactgccatattttgttgggttgtcttcttaaaagaatataagactaaagtgttaatgtcacttggtgttacatttccttacagatttttgtatagtctaatttggttaatccttgtgacattaaaaacacatacactttttaaaaaattaaaaaataagt

SEQ ID NO: 316800 - DNA, 1406 bp, Homo sapiens
  misc_feature (1387)..(1387): n is a, c, g, or t
tctcgagacagagtctcgctctgtagcccaggctggagaacagtggcgcgatctcggctcactgcaacctccgcctcctgggtccaagagattctcctgcctcagcctcccgagtagctgggattacaggcgcgcgccaccccgcccggctaagtttttgtatttttagtagagacgggtggggggaggggggagggggtcaccatgttggccaggctactctcgaaatcgtgacctcgtgatccgcccgcctcggccttccaaagtgctaggattacaggcgtgagccaccactcccggccctgggtgctggttttcttcacctccgagtgaacagcagagggggctgttgggtgagggccagaagagttggggaggcacgagggcgtccagcgctgccctcactcaagatggcggccagagcctcgcgcttggtcgcgtggggcggtgcgtgagtgcttagctcacaggctccgggaccgcgctcgggggcggagcggatagtgggaaggggacgcgcgccctgcggcccggcctctagtcatcgccctcgcagcggcggccaacatcaccgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcggagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacaaaaaaaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatngtggcctcgttggcctcaa

SEQ ID NO: 316801 - DNA, 1933 bp, Homo sapiens
  misc_feature (1914)..(1914): n is a, c, g, or t
tctcgagacagagtctcgctctgtagcccaggctggagaacagtggcgcgatctcggctcactgcaacctccgcctcctgggtccaagagattctcctgcctcagcctcccgagtagctgggattacaggcgcgcgccaccccgcccggctaagtttttgtatttttagtagagacgggtggggggaggggggagggggtcaccatgttggccaggctactctcgaaatcgtgacctcgtgatccgcccgcctcggccttccaaagtgctaggattacaggcgtgagccaccactcccggccctgggtgctggttttcttcacctccgagtgaacagcagagggggctgttgggtgagggccagaagagttggggaggcacgagggcgtccagcgctgccctcactcaagatggcggccagagcctcgcgcttggtcgcgtggggcggtgcgtgagtgcttagctcacaggctccgggaccgcgctcgggggcggagcggatagtgggaaggggacgcgcgccctgcggcccggcctctagtcatcgccctcgcagcggcggccaacatcaccgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcggaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggacccaactgggagacaaattggactcgttcattaaaccacctgagtgcagtagtgatgtcaaccttgagctccggcagcggaacagaggggacctgacagcggactcggtccagaggggttcccgccatggcctagagcagtacctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagagcttttgtttgcaaatacttgtccatatttgctccatttcttactttacaacttgcgtacatgggattatacaaatattttcccaagagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacaaaaaaaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatngtggcctcgttggcctcaa

SEQ ID NO: 316802 - DNA, 2258 bp, Homo sapiens
tctcgagacagagtctcgctctgtagcccaggctggagaacagtggcgcgatctcggctcactgcaacctccgcctcctgggtccaagagattctcctgcctcagcctcccgagtagctgggattacaggcgcgcgccaccccgcccggctaagtttttgtatttttagtagagacgggtggggggaggggggagggggtcaccatgttggccaggctactctcgaaatcgtgacctcgtgatccgcccgcctcggccttccaaagtgctaggattacaggcgtgagccaccactcccggccctgggtgctggttttcttcacctccgagtgaacagcagagggggctgttgggtgagggccagaagagttggggaggcacgagggcgtccagcgctgccctcactcaagatggcggccagagcctcgcgcttggtcgcgtggggcggtgcgtgagtgcttagctcacaggctccgggaccgcgctcgggggcggagcggatagtgggaaggggacgcgcgccctgcggcccggcctctagtcatcgccctcgcagcggcggccaacatcaccgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcggtccatatttgctccatttcttactttacaacttgcgtacatgggattatacaaatattttcccaagagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacaaaaaaaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatgaaagaaactgaattgtctaatgttaactctgcacattgtaacttttcttgttgagttagtatcttaatttttactccagcacaagtatttaatcaaagaaaagattcatacatgtgaaattggaaggtatttataaaatttttattgctgtataccaaactcagaattggaactttttacatttgagtttcactttttagaagtatgttttaagcaagcaaaaacaaaatgggatgtgaagaattgaggcatgcaacccaatagcataaatgtcctttttccccccaaatatggtctagatgagttattataaacattgtttttatttttttgagacagagtttcgctcttgttgcccaggctagagtgcaatggcgccatctcggctcaccgcaacctccaccttcctggttcaagggattctcctgcctcagcctcccaagtagctgggattacaggcatgcaccaccacgcccagctaatttttatattctttagtaaagacagggtttctccatgttggtcaggctggtctcgaacttctgacctcaggtgatctgcccacctcggcctcccaaagtgctgggattacaggcgtgagccactgcacctggccttataaatatccttttaactaactcagtaactgccatattttgttgggttgtcttcttaaaagaatataagactaaagtgttaatgtcacttggtgttacatttccttacagatttttgtatagtctaatttggttaatccttgtgacattaaaaacacatacactttttaaaaaattaaaaaataagt

SEQ ID NO: 316803 - DNA, 2192 bp, Homo sapiens
tctcgagacagagtctcgctctgtagcccaggctggagaacagtggcgcgatctcggctcactgcaacctccgcctcctgggtccaagagattctcctgcctcagcctcccgagtagctgggattacaggcgcgcgccaccccgcccggctaagtttttgtatttttagtagagacgggtggggggaggggggagggggtcaccatgttggccaggctactctcgaaatcgtgacctcgtgatccgcccgcctcggccttccaaagtgctaggattacaggcgtgagccaccactcccggccctgggtgctggttttcttcacctccgagtgaacagcagagggggctgttgggtgagggccagaagagttggggaggcacgagggcgtccagcgctgccctcactcaagatggcggccagagcctcgcgcttggtcgcgtggggcggtgcgtgagtgcttagctcacaggctccgggaccgcgctcgggggcggagcggatagtgggaaggggacgcgcgccctgcggcccggcctctagtcatcgccctcgcagcggcggccaacatcaccgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcggagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacaaaaaaaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatgaaagaaactgaattgtctaatgttaactctgcacattgtaacttttcttgttgagttagtatcttaatttttactccagcacaagtatttaatcaaagaaaagattcatacatgtgaaattggaaggtatttataaaatttttattgctgtataccaaactcagaattggaactttttacatttgagtttcactttttagaagtatgttttaagcaagcaaaaacaaaatgggatgtgaagaattgaggcatgcaacccaatagcataaatgtcctttttccccccaaatatggtctagatgagttattataaacattgtttttatttttttgagacagagtttcgctcttgttgcccaggctagagtgcaatggcgccatctcggctcaccgcaacctccaccttcctggttcaagggattctcctgcctcagcctcccaagtagctgggattacaggcatgcaccaccacgcccagctaatttttatattctttagtaaagacagggtttctccatgttggtcaggctggtctcgaacttctgacctcaggtgatctgcccacctcggcctcccaaagtgctgggattacaggcgtgagccactgcacctggccttataaatatccttttaactaactcagtaactgccatattttgttgggttgtcttcttaaaagaatataagactaaagtgttaatgtcacttggtgttacatttccttacagatttttgtatagtctaatttggttaatccttgtgacattaaaaacacatacactttttaaaaaattaaaaaataagt

SEQ ID NO: 316804 - DNA, 1471 bp, Homo sapiens
  misc_feature (27)..(28): n is a, c, g, or t
attaataatattatttaaaaaaaaaanngttgaaaaatttgcacatgttacgaagaacgagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacaaaaaaaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatgaaagaaactgaattgtctaatgttaactctgcacattgtaacttttcttgttgagttagtatcttaatttttactccagcacaagtatttaatcaaagaaaagattcatacatgtgaaattggaaggtatttataaaatttttattgctgtataccaaactcagaattggaactttttacatttgagtttcactttttagaagtatgttttaagcaagcaaaaacaaaatgggatgtgaagaattgaggcatgcaacccaatagcataaatgtcctttttccccccaaatatggtctagatgagttattataaacattgtttttatttttttgagacagagtttcgctcttgttgcccaggctagagtgcaatggcgccatctcggctcaccgcaacctccaccttcctggttcaagggattctcctgcctcagcctcccaagtagctgggattacaggcatgcaccaccacgcccagctaatttttatattctttagtaaagacagggtttctccatgttggtcaggctggtctcgaacttctgacctcaggtgatctgcccacctcggcctcccaaagtgctgggattacaggcgtgagccactgcacctggccttataaatatccttttaactaactcagtaactgccatattttgttgggttgtcttcttaaaagaatataagactaaagtgttaatgtcacttggtgttacatttccttacagatttttgtatagtctaatttggttaatccttgtgacattaaaaacacatacactttttaaaaaattaaaaaataagt

SEQ ID NO: 316805 - DNA, 1482 bp, Homo sapiens
  misc_feature (37)..(37): n is a, c, g, or t
ttctttcaccctttatcctccatccacaacccctcgnggcgcctttatgatgacagcagcaaaagccttcagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacaaaaaaaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatgaaagaaactgaattgtctaatgttaactctgcacattgtaacttttcttgttgagttagtatcttaatttttactccagcacaagtatttaatcaaagaaaagattcatacatgtgaaattggaaggtatttataaaatttttattgctgtataccaaactcagaattggaactttttacatttgagtttcactttttagaagtatgttttaagcaagcaaaaacaaaatgggatgtgaagaattgaggcatgcaacccaatagcataaatgtcctttttccccccaaatatggtctagatgagttattataaacattgtttttatttttttgagacagagtttcgctcttgttgcccaggctagagtgcaatggcgccatctcggctcaccgcaacctccaccttcctggttcaagggattctcctgcctcagcctcccaagtagctgggattacaggcatgcaccaccacgcccagctaatttttatattctttagtaaagacagggtttctccatgttggtcaggctggtctcgaacttctgacctcaggtgatctgcccacctcggcctcccaaagtgctgggattacaggcgtgagccactgcacctggccttataaatatccttttaactaactcagtaactgccatattttgttgggttgtcttcttaaaagaatataagactaaagtgttaatgtcacttggtgttacatttccttacagatttttgtatagtctaatttggttaatccttgtgacattaaaaacacatacactttttaaaaaattaaaaaataagt

SEQ ID NO: 316806 - DNA, 1481 bp, Homo sapiens
  misc_feature (57)..(57): n is a, c, g, or t
tttatttatattatatttaaaaaaaatttttaataattatcactctcacatggacanagcaaaagattcagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacaaaaaaaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatgaaagaaactgaattgtctaatgttaactctgcacattgtaacttttcttgttgagttagtatcttaatttttactccagcacaagtatttaatcaaagaaaagattcatacatgtgaaattggaaggtatttataaaatttttattgctgtataccaaactcagaattggaactttttacatttgagtttcactttttagaagtatgttttaagcaagcaaaaacaaaatgggatgtgaagaattgaggcatgcaacccaatagcataaatgtcctttttccccccaaatatggtctagatgagttattataaacattgtttttatttttttgagacagagtttcgctcttgttgcccaggctagagtgcaatggcgccatctcggctcaccgcaacctccaccttcctggttcaagggattctcctgcctcagcctcccaagtagctgggattacaggcatgcaccaccacgcccagctaatttttatattctttagtaaagacagggtttctccatgttggtcaggctggtctcgaacttctgacctcaggtgatctgcccacctcggcctcccaaagtgctgggattacaggcgtgagccactgcacctggccttataaatatccttttaactaactcagtaactgccatattttgttgggttgtcttcttaaaagaatataagactaaagtgttaatgtcacttggtgttacatttccttacagatttttgtatagtctaatttggttaatccttgtgacattaaaaacacatacactttttaaaaaattaaaaaataagt

SEQ ID NO: 316807 - DNA, 1982 bp, Homo sapiens
tctcgagacagagtctcgctctgtagcccaggctggagaacagtggcgcgatctcggctcactgcaacctccgcctcctgggtccaagagattctcctgcctcagcctcccgagtagctgggattacaggcgcgcgccaccccgcccggctaagtttttgtatttttagtagagacgggtggggggaggggggagggggtcaccatgttggccaggctactctcgaaatcgtgacctcgtgatccgcccgcctcggccttccaaagtgctaggattacaggcgtgagccaccactcccggccctgggtgctggttttcttcacctccgagtgaacagcagagggggctgttgggtgagggccagaagagttggggaggcacgagggcgtccagcgctgccctcactcaagatggcggccagagcctcgcgcttggtcgcgtggggcggtgcgtgagtgcttagctcacaggctccgggaccgcgctcgggggcggagcggatagtgggaaggggacgcgcgccctgcggcccggcctctagtcatcgccctcgcagcggcggccaacatcaccgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcggaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggacccaactgggagacaaattggactcgttcattaaaccacctgagtgcagtagtgatgtcaaccttgagctccggcagcggaacagaggggacctgacagcggactcggtccagaggggttcccgccatggcctagagcagtacctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagagcttttgtttgcaaatacttgtccatatttgctccatttcttactttacaacttgcgtacatgggattatacaaatattttcccaaggtaaattaattttttttctaaatttcgatgatgtgtttggattgatttatgactagctaattgaaggaacttaaaaatgttagtcctgcttacggtctgaatcagtgctactcaaagtgtggtttgcccacttatctccaaactatgtgtttgtgtttgttatacattaagttcaaaaaatgagtaattggccgggcgcagtggctcacgcctgtaatccccacactctaagaggctgaggtgggtggatcacctgaggtcaggagttcaagaccagcctggccaacatggtgcaaccccatctctgctaaaaatacaaaaattagccaggtatggtgacgcacacctgtaattccagctactcaggaggctgaggcaggagagttgctccaacccaggaggcagaggttgcagtgagccaagattgcgccactgcactgctccagtctgggtgacagagtgagactctgtctccaaaaaaaaaaaaaaaaaaagagtaattagaaacttttatagcaatttgacattgccataacattgttattctgttttacaaaaatactgtggattgaggtccttcatgaaaaagtgtgaatagtacttgtttaagcaaagtattaaatttaattagtaaatttagtaattcattttgtctataataaaggaaattaatta

SEQ ID NO: 316808 - DNA, 2205 bp, Homo sapiens
tctcgagacagagtctcgctctgtagcccaggctggagaacagtggcgcgatctcggctcactgcaacctccgcctcctgggtccaagagattctcctgcctcagcctcccgagtagctgggattacaggcgcgcgccaccccgcccggctaagtttttgtatttttagtagagacgggtggggggaggggggagggggtcaccatgttggccaggctactctcgaaatcgtgacctcgtgatccgcccgcctcggccttccaaagtgctaggattacaggcgtgagccaccactcccggccctgggtgctggttttcttcacctccgagtgaacagcagagggggctgttgggtgagggccagaagagttggggaggcacgagggcgtccagcgctgccctcactcaagatggcggccagagcctcgcgcttggtcgcgtggggcggtgcgtgagtgcttagctcacaggctccgggaccgcgctcgggggcggagcggatagtgggaaggggacgcgcgccctgcggcccggcctctagtcatcgccctcgcagcggcggccaacatcaccgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcggaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggacccaactgggagacaaattggactcgttcattaaaccacctgagtgcagtagtgatgtcaaccttgagctccggcagcggaacagaggggacctgacagcggactcggtccagaggggttcccgccatggcctagagcagtacctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagagcttttgtttgcaaatacttgtccatatttgctccatttcttactttacaacttgcgtacatgggattatacaaatattttcccaaggtaaattaattttttttctaaatttcgatgatgtgtttggattgatttatgactagctaattgaaggaacttaaaaatgttagtcctgcttacggtctgaatcagtgctactcaaagtgtggtttgcccacttatctccaaactatgtgtttgtgtttgttatacattaagttcaaaaaatgagtaattggccgggcgcagtggctcacgcctgtaatccccacactctaagaggctgaggtgggtggatcacctgaggtcaggagttcaagaccagcctggccaacatggtgcaaccccatctctgctaaaaatacaaaaattagccaggtatggtgacgcacacctgtaattccagctactcaggaggctgaggcaggagagttgctccaacccaggaggcagaggttgcagtgagccaagattgcgccactgcactgctccagtctgggtgacagagtgagactctgtctccaaaaaaaaaaaaaaaaaaagagtaattagaaacttttatagcaatttgacattgccataacattgttattctgttttacaaaaatactgtggattgaggtccttcatgaaaaagtgtgaatagtacttgtttaagcaaagtattaaatttaattagtaaatttagtaattcattttgtctataataaaggaaattaattaaaaaatggatttgattatctcattgtacttcatattggacacttaatagcagtgcactttatcttcagtgttgagggcctgatatttgcaataaatatttggccaatattacagaacagaatgatgttgagagtcaatgtttacctggcctacttgactacagatatatacagttttatgaggcttggcttgcctgacatagacgatagcctaactagtgtga

SEQ ID NO: 316809 - DNA, 1212 bp, Homo sapiens
gctgagattgagccactgcactccagcctgggtgacagagcgagactccatcttaaaaaaaaaaagcaattgccaggcgcggtgtctcatacctgtaatcccagcatgttgggaggccgaggtgggtggatcacgaggtcaggagttctagaccatactggccaacatggtgaaaccctgtctctactaaaaatacaaaaattagccaggtgtggtggcgggcgcctgtaatcccatctactcagaaggctgaggcacgagcatcgcttgaatctgggaggtggatgttgccatgaaccaagatcgtgccactgcactcagcctgggtgacagaggaagactccgtctcaaaaaataataataacaacattttcttacagcttttgcttggaattttctagctgctgtttgatttattgtgatttgaatgattatgttggaaatatttaattttatcttctatcttcacagtccatatttgctccatttcttactttacaacttgcgtacatgggattatacaaatattttcccaaggtaaattaattttttttctaaatttcgatgatgtgtttggattgatttatgactagctaattgaaggaacttaaaaatgttagtcctgcttacggtctgaatcagtgctactcaaagtgtggtttgcccacttatctccaaactatgtgtttgtgtttgttatacattaagttcaaaaaatgagtaattggccgggcgcagtggctcacgcctgtaatccccacactctaagaggctgaggtgggtggatcacctgaggtcaggagttcaagaccagcctggccaacatggtgcaaccccatctctgctaaaaatacaaaaattagccaggtatggtgacgcacacctgtaattccagctactcaggaggctgaggcaggagagttgctccaacccaggaggcagaggttgcagtgagccaagattgcgccactgcactgctccagtctgggtgacagagtgagactctgtctccaaaaaaaaaaaaaaaaaaagagtaattagaaacttttatagcaatttgacattgccataacattgttattctgttttacaaaaatactgtggattgaggtccttcatgaaaaagtgtgaatagtacttgtttaagcaaagtattaaatttaattagtaaatttagtaattcattttgtctataataaaggaaattaatta

SEQ ID NO: 316810 - DNA, 1122 bp, Homo sapiens
accccgtctcaaaaatatatgtatgtgtatatatttgggggaaaaataacaatacaacaataacaaatagtaaataatacaaataaaaacagtataacaactatttacattgcattaggcataaaaaatctagaaatgatttaaagtatatgggaggaagtgagtaggttatatttactgtgccgttttacataagggacttgagcatctatggattttggtatcaggaggaacctggtaccagtcctctgctgatactgagggatgactgtactaaaacccatttttcattctacggacctttctcattgttttgcatacattaattcatctaatcctcattcttatgaacttggtattatgtgaatccattgggaaatgaagactcagagaggttaaaccatttgcccaaggtcacacagctactaagcggtgctaggattaaaccctggcagtttcagtccttaaccaaagggttaagcgctttacatatatatactgtatattatcaattttcaaataatttgaaatagtaaaatgcagttcctctggtcctgaatatgaggtaatcttcctatggttcagaagacatttcagcatttcctaatatatcataatgagtccattttggttgtaccatgatgtagtcattttgttttatagtatattaaagaatgcagaaaagcatagctcatagttcagtgtcttgctctgaggtttttccattcagtagacattttaagtatatgtaccaggcacataaatatccagataattaaagtttatatcattaagcaaaacagtttttgtaaatctttttttttttgaggtggagtttctttcgccaggctggagttgcagtgagccaagattgcgccactgcactgctccagtctgggtgacagagtgagactctgtctccaaaaaaaaaaaaaaaaaaagagtaattagaaacttttatagcaatttgacattgccataacattgttattctgttttacaaaaatactgtggattgaggtccttcatgaaaaagtgtgaatagtacttgtttaagcaaagtattaaatttaattagtaaatttagtaattcattttgtctataataaaggaaattaatta

SEQ ID NO: 316811 - DNA, 654 bp, Homo sapiens
cccgccatggcctagagcagtacctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagagcttttgtttgcaaatacttggtaagaaaagatctgtaaattattaactaacttaatggaaaatgcaaaatgttaataattatgagtgcttttgatcatagaagtcattgccagtattaatatctaccagatccatgtggctgtttgaagatatattattaactttgctattcatctcatagaatgaagtgttctggttaaatacagagcctaataattactgttggccctccatatcagttggttctgcaccctatgtggattcaaccaattgtggattgaaaatatttggatttagccgggcgtggtggtgcacgcctgtaatcccagttacttgggaggctgaggcaggagaatcgcttgaacccgggaggtggaggttgcagtgagccaggataacggcactgcactccagcctgggtgacagagtgagaccccgtctcaaaaatatatgtatgtgtatatatttgggggaaaaataaca

SEQ ID NO: 316812 - DNA, 4580 bp, Homo sapiens
  misc_feature (455)..(455): n is a, c, g, or t
  misc_feature (475)..(476): n is a, c, g, or t
  misc_feature (844)..(844): n is a, c, g, or t
  misc_feature (2105)..(2105): n is a, c, g, or t
aattgtcagcagagaagccaaacttcagtttgcctatcttgaaaattttaaaaccaaaatgaggagtacagtgtctgtgcgtgaaggccagggagttgtgctgctctgcggccccccaccacactctggagaactgtcatatgcttggatcttcaatgaatacccatcgtttgttgaagaagatagtcggagatttgtcaagaattagtcatcactcccaggagacagggcacctctacatatctaaggtggagccgtctgatgtgggaaattacacatgtgtggtgacaagtatggtgacaaatgcccgagtgctgggctctccaactcctttggtgctacgttctgatggtgtgatgggtgaatatgaacctaaaatagaagttcagtttccagaaactcttccagcagctaaaggttcgactgtgaaattggaatgttttgcccttggaaancccatacctcagattaattnnaaagaaggatgggctgccatttccagcaaaattaaattaaggaagttcagggtgtgcttgaaatccccaacttccaacaggaagatgcaggttcctatgaatgcattgctgagaattcacgaggaaaaaatgttgccagagggcgtctcacttactatgcaaagccccattgggttcaactcataaaggatgtggaaatagccgtggaggacagtctttattgggaatgcagggcaagcggcaagcccaagccttcctaccgatggctgaaaaatggagcagccctggtgctagaggagagaacacagatagaaaatggtgcccttacaatatcaaacctaagtgtgactgattctggcatgttccantgcatagcaaaaacaaacatggccttgttattccagtgctgcttctgctccagatttttcaaagaatccaatgaagaagttggttcaggtgcaggtgggcagcctggtcagcttggattgtaaacccagagcctccccaagggcactctcttcctggaagaagggggatgtgagcgtgcaggagcatgaaagaatttctttgttaaacgatggaggactcaaaatagccaatgtgactaaagctgatgctggaacttacacctgcatggcagaaaaccagtttgggaaagcaaatggcacaacacatttggttgttacggaaccaacaagaataactttggcaccatctaacatggatgtttctgttggtgaaagcgtcatattgccctgccaggtacaacatgacccgctgttagacatcatctttacctggtatttcaatggggcccttgcagattttaagaaagatggatctcactttgagaaagttggtgggagttcatctggtgatttaatgatcagaaacattcagctgaaacacagtgggaaatatgtttgtatggtgcaaacgggggtggacagtgtttcatctgctgctgacctcatagtaagaggttcacctggaccaccagaaaatgtgaaggtagatgaaattacagacacaacagcccaactctcttggaaagaaggtaaagacaaccatagcccagttatatcctattctatccaggctcggacacctttctccgtgggttggcaaaccgtcacaacagtgcctgaggtcatcgatgggaagacgcacacagccactgtagttgagttaaacccatgggtggaatatgaatttcgggttgtagccagtaacaaaattggaggtggagaaccaagtttaccctcagaaaaagtaagaactgaagaggcagttccagaagtgcctccttctgaagtcaatggaggaggcggaagccggtctgaacttgtgataacctgggatccagtccctgaagaactacagaatggtgaaggttttgggtatgttgttgctttccgccctcttggggttaccacctggatccagacagtggtgacatcccctgacaccccaagatatgtctttaggaatgaaagcatcgtgccatattcaccatatgaagttaaagtgggtgtttataataacaaaggtgaaggaccatttagcccagtgacaacagtgttctctgcagaagaagagcctacagtggccccatctcaagtctctgcnaatagcctatcttcctcagaaattgaggtttcatggaacaccattccttggaagttgagcaatggacatttactgggctatgaggtgcggtactggaatgggggtggaaaggaggaatcatccagtaagatgaaagtggcaggaaatgagacatcagccagactacggggcctgaagagcaacctggcctattacacggctgtccgggcttacaacagtgccggcgctgggccttttagcgccacagttaatgtaaccaccaagaaaacgcctcccagtcagccaccaggaaatgttgtttggaatgccacagacactaaagtgttacttaattgggagcaagttaaagccatggagaatgagtcagaagtaacaggatataaagttttctataggactagcagtcaaaataacgtacaagtactgaacacaaataaaacttcagctgaacttgtgctgcccattaaagaggactacattattgaagtcaaggccacaacagatggaggggatgggaccagtagtgaacagatcaggattccacgaataaccagtatggatgcaagaggatccacttcagccatctcgaatgtccaccctatgtcaagttatatgcctatagtactgttcttaattgtatatgtcctgtggtgatattaactcctttttattatttattggaaagttatttggttaccaaaaaaagtgctttcatgaaatgcagtgattatgcatgtttttttcaactcttatttttaactttctacttcattataggtaaatatgaatataattaaaaaaacagtaaatccttttaggggaatctgaaatgccttaatattaacttgataaaccaaaggaatttacatattacatacttcagacttttgatataaatgttcttaaactatgagtttaagcactgcctatggataaagactcacacactctcacatgtacacacacacgcatgagaatttctttttacattgaaaaactctttcatttaattcaaatgctattttcccattataatagcattatttggaagacttaaccagtatcaatttgaaatgctgatttaagtccccaaggatgaaaaatacattttaaaaattattttgttggagaggagtggcatgtgattcaaaagagcattgttggaaaatgctactgtggggcttagaagaatgatgtttggtttggtatgctgctaactagttgtaagactttacaaatcactttgccatctgtacctctcaattattcctctataaaatatggagataataatacctatctgatcagactttgccccatgaattagtttttaaaagataaagactgaagtatgaaagtgcttttgtcaccccaaatgcaattgacccatgcaaaatattagcatgaatttatttaatcacataaaagtcatgaagaccagccagattttcaagcttcattctgtttcattcagttatattccaaaattcaaatgatcacattttattctttctcaaaaaaaaaaagtttttttaaattaaaaaaggaattgtttccttcacagctatgaataagctttcaggttttattaaaacctagaggaaaaaatcaggaatgacctgaatctcaacccaaatattaaacaaaatccacataatccctcatttcaatttccaattccattaagggaccctctctttttggatggcagagatggttttttaatgaaatcccaccatctatctgagtgagtctggcaggctttttagttcctgagttaaatttgtaatagaaccaaggcaatgctgctgactttgatatgtatgactcagtctttcaatatgtggttttcaaaaaattgttgaagacgtgacttcatagcaatatatagagaataaattaaaatcagcagattgagttttcaacattgcaaaatcagttttttacctctttcctaccaatttcacattttgcagaaacttgttcacatttccaacaatatcagaattagaaaacagttcagataacaagaaagattaaaaattagggaaattctgatatcaccataaagcactattttacatttagagattacatttaagataaagtcatcatacacaaaaacaataaatatttataactttctctataaggtccgcatatactgtatatattgaaacaatctgaatgactagtagatttcatatgaccattgttatttccactttctccaatacttgtattttatgctacatgtaatgaagttggacctttttattatttagtaattcctatatgttcctatacttttcattttcaagatgattgctctattgtttcatgttgtttctagcaatatatctccatgagatatgcactttgtttcatattgaaaagtataaaatttatctttcaattcctgtgtgtgtatcctatggttatctgtatgtattattttctattctaataaaattt

SEQ ID NO: 316813 - DNA, 333 bp, Homo sapiens
ttggaagtaaagttgatgtttgtatagatacattaaggacacaatggaaaactgtccttaatgatggaatttctttctctcttcaacaattttattagaactgtcatatgcttggatcttcaatgatgaactaacatctattgaagaattagtcatcactcccaggagacagggcacctctacatatctaaggtggagccgtctgatgtgggaaattacacatgtgtggtgacaagtatggtgacaaatgcccgagtgctgggctctccaactcctttggtgctacgttctgatggtaatgaaacttctccaagtgcacttctgagcgtaaat

SEQ ID NO: 316814 - DNA, 848 bp, Homo sapiens
ctctgcttctcgggtagctgggattacgggcgtgtgccaccacgcccggctactttttggatttttagtagaaatagggtttcaccatgttagccaggctggtctcgaactgctgacctcaggtgatctgcctgcctcggcctcccaaagtgctgggattacaggcgtgagccattgcgcctggccagaaaaatacctttaaaaagctgggcctgttggtgtacctaaaggataatacagatgttcctctcaacttagcatggggttgtgtctcaataaacccatttttaagttgaaaacgttaagtggaaaatgcatttattatacctaacctactagacctcgtagtttagcctcccttaccctacaggtgctcagaacacttagtagcctacagttgagcagtcatctaacacaaaacctattttatagtaaagtgttgaatatctcaagtaatttattgatgttccactgaatgcgaatcacttttgcaccgttgttaagttgaaccattgtatgtttgtgaccatctgtacttgtaatttctttacattcattggtatgaaaaatatgttcttagaagcaggaaaaagaattcagttttgctttgtatactaaattagatgctgtaattttgataaaatgaaaaatctgctttatttgcaacaattgttttcttccttgacgtcagcctcactcttggactttgctactcagcctgtcacccctgtgaattcccatgaggttgacagtgtaaacctgctctaagttttcactttgcactgtgtaccaaaatgaaactgcttatttaggaaaataaaaatatcttttgtgttggacaaaataca

SEQ ID NO: 316815 - DNA, 1870 bp, Homo sapiens
tcggtcccgcgccctccgggctcgcagggacgtctcctccctcccggctcgcggccccgcccggcccggcccccgcccagagccccagcgcgccgaggatgtgagtcctgctcgcctctggcggagcagcagccactcgcgcgcggagccggagcgcagcgcagcgcagccgcgggcgctctccgggccgctcgcgcgagtgccgcgctcttgccctagcggcgtcccccggcctctcgccggcgccaccgccgcagcagcccgcgggccgtccccggccggccgcccccggccccagcgccgctgaccctgtccgccgcgggcggggacgcgggcggaggaggcgccgcggcggagcccccggacgcgaccatgtcggaggtgctgccctacggcgacgagaagctgagcccctacggcgacggcggcgacgtgggccagatcttctcctgccgcctgcaggacaccaacaacttcttcggcgccgggcagaacaagcggccgcccaagctgggccagatcggccggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggacacattttttatgtcagaaaaacacacacacacacacacacacacacacacacacacacacacgaaaaacaaagaaaaaaatgcttgagctttttctaacttccccttgcagtctgttgtgtgagcagcctgtttatttctctaatattatgtcagtttattctctttaatggactgtaaaaaaatgtaatcacaagagtgccaaatatcttgaaatgccaaaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttcccttccccgttccctcttttcttaattcaatattctgtatgttgcaccttgaaccagcacacagggctatttctccaatgtacaataaaagaattgttcctgtgtc

SEQ ID NO: 316816 - DNA, 1598 bp, Homo sapiens
gcagagagagactgagacgcagggatggaggggagggggtacgcgggagaccgagggtggcagagaccgagacaaagctcccgagaggggagctgaagcgggagagacagagccgaggacgcgcgtttggggaggacgcagaagccgccgaaacaataagggcgaccgacaccttagacagggagagacagagacctcgatcggctgccggccgtcgcgccgagggacgatggagggactgagaaaggcgaggctaagtcgagacgttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggacacattttttatgtcagaaaaacacacacacacacacacacacacacacacacacacacacacgaaaaacaaagaaaaaaatgcttgagctttttctaacttccccttgcagtctgttgtgtgagcagcctgtttatttctctaatattatgtcagtttattctctttaatggactgtaaaaaaatgtaatcacaagagtgccaaatatcttgaaatgccaaaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttcccttccccgttccctcttttcttaattcaatattctgtatgttgcaccttgaaccagcacacagggctatttctccaatgtacaataaaagaattgttcctgtgtc

SEQ ID NO: 316817 - DNA, 1356 bp, Homo sapiens
ccagatcggtctggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggacacattttttatgtcagaaaaacacacacacacacacacacacacacacacacacacacacacgaaaaacaaagaaaaaaatgcttgagctttttctaacttccccttgcagtctgttgtgtgagcagcctgtttatttctctaatattatgtcagtttattctctttaatggactgtaaaaaaatgtaatcacaagagtgccaaatatcttgaaatgccaaaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttcccttccccgttccctcttttcttaattcaatattctgtatgttgcaccttgaaccagcacacagggctatttctccaatgtacaataaaagaattgttcctgtgtc

SEQ ID NO: 316818 - DNA, 1313 bp, Homo sapiens
gtctagaggagtcccccctacgttgctcgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggacacattttttatgtcagaaaaacacacacacacacacacacacacacacacacacacacacacgaaaaacaaagaaaaaaatgcttgagctttttctaacttccccttgcagtctgttgtgtgagcagcctgtttatttctctaatattatgtcagtttattctctttaatggactgtaaaaaaatgtaatcacaagagtgccaaatatcttgaaatgccaaaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttcccttccccgttccctcttttcttaattcaatattctgtatgttgcaccttgaaccagcacacagggctatttctccaatgtacaataaaagaattgttcctgtgtc

SEQ ID NO: 316819 - DNA, 1327 bp, Homo sapiens
tcggtcccgcgccctccgggctcgcagggacgtctcctccctcccggctcgcggccccgcccggcccggcccccgcccagagccccagcgcgccgaggatgtgagtcctgctcgcctctggcggagcagcagccactcgcgcgcggagccggagcgcagcgcagcgcagccgcgggcgctctccgggccgctcgcgcgagtgccgcgctcttgccctagcggcgtcccccggcctctcgccggcgccaccgccgcagcagcccgcgggccgtccccggccggccgcccccggccccagcgccgctgaccctgtccgccgcgggcggggacgcgggcggaggaggcgccgcggcggagcccccggacgcgaccatgtcggaggtgctgccctacggcgacgagaagctgagcccctacggcgacggcggcgacgtgggccagatcttctcctgccgcctgcaggacaccaacaacttcttcggcgccgggcagaacaagcggccgcccaagctgggccagatcggccggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttatacaataagggaaaaatatgtaagcgatcatgggaagcacagacaatgcagaaaatgatccctgatagatatgcagttgtacgccgtgttaattgggaggacagaaatccaacacatattatttaacaagacagatgatctttactaaggaatagatacatacataagagttttacctaacaatagcgatatgcagcgcagtttctttg

SEQ ID NO: 316820 - DNA, 1178 bp, Homo sapiens
tcggtcccgcgccctccgggctcgcagggacgtctcctccctcccggctcgcggccccgcccggcccggcccccgcccagagccccagcgcgccgaggatgtgagtcctgctcgcctctggcggagcagcagccactcgcgcgcggagccggagcgcagcgcagcgcagccgcgggcgctctccgggccgctcgcgcgagtgccgcgctcttgccctagcggcgtcccccggcctctcgccggcgccaccgccgcagcagcccgcgggccgtccccggccggccgcccccggccccagcgccgctgaccctgtccgccgcgggcggggacgcgggcggaggaggcgccgcggcggagcccccggacgcgaccatgtcggaggtgctgccctacggcgacgagaagctgagcccctacggcgacggcggcgacgtgggccagatcttctcctgccgcctgcaggacaccaacaacttcttcggcgccgggcagaacaagcggccgcccaagctgggccagatcggccggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattgtacatccaaggataacaacataaaaaaaataaaactggacagcatttcacatccaag

SEQ ID NO: 316821 - DNA, 978 bp, Homo sapiens
tcggtcccgcgccctccgggctcgcagggacgtctcctccctcccggctcgcggccccgcccggcccggcccccgcccagagccccagcgcgccgaggatgtgagtcctgctcgcctctggcggagcagcagccactcgcgcgcggagccggagcgcagcgcagcgcagccgcgggcgctctccgggccgctcgcgcgagtgccgcgctcttgccctagcggcgtcccccggcctctcgccggcgccaccgccgcagcagcccgcgggccgtccccggccggccgcccccggccccagcgccgctgaccctgtccgccgcgggcggggacgcgggcggaggaggcgccgcggcggagcccccggacgcgaccatgtcggaggtgctgccctacggcgacgagaagctgagcccctacggcgacggcggcgacgtgggccagatcttctcctgccgcctgcaggacaccaacaacttcttcggcgccgggcagaacaagcggccgcccaagctgggccagatcggccggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcgagggatcttgaactggtcagagaagaggaagaggaaatgaaggtcgttgtcgagcacgtag

SEQ ID NO: 316822 - DNA, 2337 bp, Homo sapiens
tcggtcccgcgccctccgggctcgcagggacgtctcctccctcccggctcgcggccccgcccggcccggcccccgcccagagccccagcgcgccgaggatgtgagtcctgctcgcctctggcggagcagcagccactcgcgcgcggagccggagcgcagcgcagcgcagccgcgggcgctctccgggccgctcgcgcgagtgccgcgctcttgccctagcggcgtcccccggcctctcgccggcgccaccgccgcagcagcccgcgggccgtccccggccggccgcccccggccccagcgccgctgaccctgtccgccgcgggcggggacgcgggcggaggaggcgccgcggcggagcccccggacgcgaccatgtcggaggtgctgccctacggcgacgagaagctgagcccctacggcgacggcggcgacgtgggccagatcttctcctgccgcctgcaggacaccaacaacttcttcggcgccgggcagaacaagcggccgcccaagctgggccagatcggccggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggacacattttttatgtcagaaaaacacacacacacacacacacacacacacacacacacacacacgaaaaacaaagaaaaaaatgcttgagctttttctaacttccccttgcagtctgttgtgtgagcagcctgtttatttctctaatattatgtcagtttattctctttaatggactgtaaaaaaatgtaatcacaagagtgccaaatatcttgaaatgccaaaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttcccttccccgttccctcttttcttaattcaatattctgtatgttgcaccttgaaccagcacacagggctatttctccaatgtacaataaaagaattgttcctgtgtcaaaaaaaaaaaaaaaaaaaaaaaaaaaaaaaaaaaaaaaaaaaaagaaacgagaaaaaaaaaaactaaaagaaacaatagaaacacagagggggcgggagcgcgcttaatatagtaatcaatccccgggaagcgcggccaccataatagcgcagacaccgcgactttttctgaaagaaaaggaggcgccaccgacctagatgagcgccaactaaaaaacacagatagagacgaccgccaggcgtataaaacacaaagactagagagggaaaaaaacctgctcgaccgcaggagcactaggaagaagacccccccatccgggggcggggcaacaaaacggggcaaacaccgtcccaaggaggacgacgccagcagcagaaaataaaccacatgaggtgttaaggggccacacaaccgcatagctcgcgaaagaagctcgcaccagcgattaactgcaaactatacggg

SEQ ID NO: 316823 - DNA, 1436 bp, Homo sapiens
tcggtcccgcgccctccgggctcgcagggacgtctcctccctcccggctcgcggccccgcccggcccggcccccgcccagagccccagcgcgccgaggatgtgagtcctgctcgcctctggcggagcagcagccactcgcgcgcggagccggagcgcagcgcagcgcagccgcgggcgctctccgggccgctcgcgcgagtgccgcgctcttgccctagcggcgtcccccggcctctcgccggcgccaccgccgcagcagcccgcgggccgtccccggccggccgcccccggccccagcgccgctgaccctgtccgccgcgggcggggacgcgggcggaggaggcgccgcggcggagcccccggacgcgaccatgtcggaggtgctgccctacggcgacgagaagctgagcccctacggcgacggcggcgacgtgggccagatcttctcctgccgcctgcaggacaccaacaacttcttcggcgccgggcagaacaagcggccgcccaagctgggccagatcggccggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggacacattttttatgtcagaaaaacacacacacacacacataatattttaatacactgacatcttatttgacccaaaacaaaaaaaaatggtgg

SEQ ID NO: 316824 - DNA, 203 bp, Homo sapiens
ggacttctggaatccatctgcaaggaatgccagctggtggctcttaaatacccagaaacctaacaaagagtactggacaatgtggaaacttaagaagtgggacaacataggcactaccagctatcggggtgtaagagaggggagttatgggtgaattgcattcagtgaaggcttcacagaggaagagaaggtgaacctgagtc

SEQ ID NO: 316825 - DNA, 393 bp, Homo sapiens
tggggacagagaagtcctagccccagatctcccagggctgctgggcgtatcacaatacctaatttttatcgaaagtttattctgtgccagacactttctaaattctctatatcagttcatcctcctaacaaccctctaaaacaaatgctattattatctccactttagacagaaggaagtaaggtcaaagaggttaaataacttgctcagggttagccgtctataatcccggttgggcaaggattcaaaataggggtgtctattgcaggagcctgtcctctgaaccacagtgctgtgattcctctggggatccccatttgagttcatggcactggcatccttccagttccttcaaacatcagcattgccatccatccttcccaccactcacca

SEQ ID NO: 316826 - DNA, 219 bp, Homo sapiens
cttgttgggaggccggagttgggcctggagacgcagccgggaggaagagctgggcccggagaggacgccgggaggctgcaagtgggtctggagaggccaacttgaggaggcccagcctctgcctcccgcatggcggcctctgcaggcccagctgttcctcctggctgcatctcccggcccagctcctgcctcccagcaagcaagctctttcggctcagc

SEQ ID NO: 316827 - DNA, 3487 bp, Homo sapiens
gcaccaaatatgtctgagtacgaggctgggtgttaatcggcacgagggtggtcatggcgctgttcccagcctttgcggggcttagtgaggctcccgatggcgggagctccaggaaagtcaaggaaataatgctgcagctgatactggacatcgctttgtttggcttgaggacattcaggctgtgacgggagaaaccttcagaacagataagaaaccagatcctgcgaactgggagtacaagtctctctaccgaggggatatagcaagatacaagaggaaaggagactcctgccttggcattaaccctaagaagcagtgcatatcttgggaagggacttccacagagaagaagcattcacgcaagcaggttgaacgctattttactaagaagagtgtgggattaatgaacatcgatggagttgccattagcagtaaaactgaacctccctcatctgagcccatctcctttataccagtgaaggacttggaagatgcggctcctgttacaacctggttgaatcctctggggatttatgatcagtcaaccacacattggctacaaggacagggtcctccagagcaggaatcaaagcagccagacgcacagccagacagcgagagtgcggctctcaaggccaaggtggaggagtttaacaggagggtgcgggagaatcctcgggatacgcagctgtggatggcatttgttgcttttcaggacgaggtcatgaaaagtcctggcctgtatgccatcgaggaaggagagcaggaaaagcgaaagaggtccctgaagctcattctggagaagaagctggccattctggagcgggccattgagagcaaccagagcagtgtggatctgaaactggccaagctgaagctctgcacagagttctgggagccctccactctggtcaaagagtggcagaaactgatatttttgcatcccaataatacagccctttggcagaaataccttttattttgccagagccagtttagtaccttttcgatatcaaaaattcacagtctttatggaaaatgcttgagcactttgtctgctgttaaggacggcagcatcttatctcaccctgcgttgcctggcacggaagaggccatgtttgcactctttcttcagcagtgccactttctgcggcaggctggccactctgagaaggccatctcattgttccaggccatggtggacttcaccttcttcaaacccgacagcgtaaaagatctgcctaccaaaggacaggtggaattctttgaacccttttgggacagtggagagccccgggctggggagaagggagcccgaggctggaaggcgtggatgcaccagcaggaacgaggtggctgggtggtcatcaacccagatgaggatgacgatgaaccagaagaggatgaccaggaaataaaagataagactctgcccaggtggcagatctggcttgctgctgagcgttcccgtgaccagaggcactggcggccctggcgccctgataagaccaagaagcaaaccgaggaagactgtgaggatcccgagagacaggtgttgtttgatgatattgggcaatctttgatcagactttccagccatgatcttcagttccagctggtggaggccttcctgcagttcttgggtgtgccttctggctttactcctccagcctcctgtctttatctggccatggatgagaacagcatctttgataatggactttatgatgaaaagcccttgacttttttcaaccctttgttttctggggctagctgtgttggccgcatggataggttgggctatcctcgctggaccaggggtcagaaccgagagggcgaggagttcatccgcaatgtcttccaccttgtcatgcctttattttcaggcaaagagaagtcccagctctgcttctcctggttacagtatgagattgcaaaggtcatttggtgcctgcacactaaaaacaagaagagattaaagtctcaagggaagaactgcaaaaaactagccaagaatctccttaaggagccagaaaactgcaacaacttttgcctgtggaagcagtatgcacatctggagtggttgcttggcaacacggaggatgccagaaaagtttttgacacagcacttggcatggcaggaagcagagaactgaaagactctgacctctgtgagctcagtctgctctatgctgagctggaggtggagctgtcgccagaagtgagaagggctgccacagctcgagctgttcacatattaaccaagctgactgagagcagcccctatgggccctacactggacaggtgttggctgttcacattttgaaagcgcgaaaggcttatgagcacgcactgcaggactgtttgggtgacagctgtgtctccaatccagctcccaccgattcctgtagccgcctaattagcctggctaaatgcttcatgctcttccagtatttgaccatagggattgatgctgctgtgcagatatacgaacaggtgtttgcaaaactgaacagttctgttttcccagaaggctctggcgagggggacagtgccagctcccagagttggaccagtgttctcgaagccatcacactgatgcacacgagcctgctgagattccacatgaaagtgagtgtttacccgctggcccctctgcgagaggcactctcacaggctttaaagttgtatccaggcaaccaggttctttggaggtcctatgtacagattcagaataagtcccacagtgccagcaaaaccaggagattttttgacacaatcaccaggtctgccaaacccttggagccttggttgtttgcaattgaagctgagaaactgaggaagagactggtggaaactgtccagaggttagacggtagagagatccacgccacaattcctgagaccggcttaatgcatcggatccaagccctgtttgaaaatgccatgcgcagcgacagtggcagccagtgccccttgctgtggaggatgtatttgaactttctggtttccttaggaaataaagaaagaagcaaaggtgtattctacaaagcacttcagaattgcccttgggcaaaggtgttgtacctggacgccgtggagtatttccccgatgagatgcaggagatcctggacctgatgactgagaaggagctccgggtgcgcctgccgctggaggagctggagctgctgctggaggattagagagcagcgggaaaacgggctgtgcctgcgaggccaagttgcccaccctgcggagctaggaggcgcgagcagagaacgtgtgtgttaggagaactcggcttttgaaatgttctttctcgatagtaataatgtgggctgccagcctctcacatcttgcacactttttgggtgtgtaaatgacacaaaagttatttacatattatatatgtgaatatgtgtatatatgtacatagccagagagtcatgccacgtggtcattaaaccgatgatgattgaggcgtg

SEQ ID NO: 316828 - DNA, 5305 bp, Homo sapiens
gcaccaaatatgtctgagtacgaggctgggtgttaatcggcacgagggtggtcatggcgctgttcccagcctttgcggggcttagtgaggctcccgatggcgggagctccaggaaagtcaaggaaataatgctgcagctgatactggacatcgctttgtttggcttgaggacattcaggctgtgacgggagaaaccttcagaacagataagaaaccagatcctgcgaactgggagtacaagtctctctaccgaggggatatagcaagatacaagaggaaaggagactcctgccttggcattaaccctaagaagcagtgcatatcttgggaagggacttccacagagaagaagcattcacgcaagcaggttgaacgctattttactaagaagagtgtgggattaatgaacatcgatggagttgccattagcagtaaaactgaacctccctcatctgagcccatctcctttataccagtgaaggacttggaagatgcggctcctgttacaacctggttgaatcctctggggatttatgatcagtcaaccacacattggctacaaggacagggtcctccagagcaggaatcaaagcagccagacgcacagccagacagcgagagtgcggctctcaaggccaaggtggaggagtttaacaggagggtgcgggagaatcctcgggatacgcagctgtggatggcatttgttgcttttcaggacgaggtcatgaaaagtcctggcctgtatgccatcgaggaaggagagcaggaaaagcgaaagaggtccctgaagctcattctggagaagaagctggccattctggagcgggccattgagagcaaccagagcagtgtggatctgaaactggccaagctgaagctctgcacagagttctgggagccctccactctggtcaaagagtggcagaaactgatatttttgcatcccaataatacagccctttggcagaaataccttttattttgccagagccagtttagtaccttttcgatatcaaaaattcacagtctttatggaaaatgcttgagcactttgtctgctgttaaggacggcagcatcttatctcaccctgcgttgcctggcacggaagaggccatgtttgcactctttcttcagcagtgccactttctgcggcaggctggccactctgagaaggccatctcattgttccaggccatggtggacttcaccttcttcaaacccgacagcgtaaaagatctgcctaccaaaggacaggtggaattctttgaacccttttgggacagtggagagccccgggctggggagaagggagcccgaggctggaaggcgtggatgcaccagcaggaacgaggtggctgggtggtcatcaacccagatgaggatgacgatgaaccagaagaggatgaccaggaaataaaagataagactctgcccaggtggcagatctggcttgctgctgagcgttcccgtgaccagaggcactggcggccctggcgccctgataagaccaagaagcaaaccgaggaagactgtgaggatcccgagagacaggtgttgtttgatgatattgggcaatctttgatcagactttccagccatgatcttcagttccagctggtggaggccttcctgcagttcttgggtgtgccttctggctttactcctccagcctcctgtctttatctggccatggatgagaacagcatctttgataatggactttatgatgaaaagcccttgacttttttcaaccctttgttttctggggctagctgtgttggccgcatggataggttgggctatcctcgctggaccaggggtcagaaccgagagggcgaggagttcatccgcaatgtcttccaccttgtcatgcctttattttcaggcaaagagaagtcccagctctgcttctcctggttacagtatgagattgcaaaggtcatttggtgcctgcacactaaaaacaagaagagattaaagtctcaagggaagaactgcaaaaaactagccaagaatctccttaaggagccagaaaactgcaacaacttttgcctgtggaagcagtatgcacatctggagtggttgcttggcaacacggaggatgccagaaaagtttttgacacagcacttggcatggcaggaagcagagaactgaaagactctgacctctgtgagctcagtctgctctatgctgagctggaggtggagctgtcgccagaagtgagaagggctgccacagctcgagctgttcacatattaaccaagctgactgagagcagcccctatgggccctacactggacaggtgttggctgttcacattttgaaagcgcgaaaggcttatgagcacgcactgcaggactgtttgggtgacagctgtgtctccaatccagctcccaccgattcctgtagccgcctaattagcctggctaaatgcttcatgctcttccagtatttgaccatagggattgatgctgctgtgcagatatacgaacaggtgtttgcaaaactgaacagttctgttttcccagaaggctctggcgagggggacagtgccagctcccagagttggaccagtgttctcgaagccatcacactgatgcacacgagcctgctgagattccacatgaaagtgagtgtttacccgctggcccctctgcgagaggcactctcacaggctttaaagttgtatccaggcaaccaggttctttggaggtcctatgtacagattcagaataagtcccacagtgccagcaaaaccaggagattttttgacacaatcaccaggtctgccaaacccttggagccttggttgtttgcaattgaagctgagaaactgaggaagagactggtggaaactgtccagaggttagacggtagagagatccacgccacaattcctgagaccggcttaatgcatcggatccaagccctgtttgaaaatgccatgcgcagcgacagtggcagccagtgccccttgctgtggaggatgtatttgaactttctggtttccttaggaaataaagaaagaagcaaaggtgtattctacaaagcacttcagaattgcccttgggcaaaggtgttgtacctggacgccgtggagtatttccccgatgagatgcaggagatcctggacctgatgactgagaaggagctccgggtgcgcctgccgctggaggagctggagctgctgctggaggattagagagcagcgggaaaacgggctgtgcctgcgaggccaagttgcccaccctgcggagctaggaggcgcgagcagagaacgtgtgtgttaggagaactcggcttttgaaatgttctttctcgatagtaataatgtgggctgccagcctctcacatcttgcacactttttgggtgtgtaaatgacacaaaagttatttacatattatatatgtgaatatgtgtatatatgtacatagccagagagtcatgccacgtggtcattaaaccgatgatgattgaggcgtggcagcgtccttgctcattctctccctgtgcgcagccagcactggcccccgcacggtgaatgtgttccctccgctggtgtcgtggtggtcctgccaggccctctctgagataaaggtctggtttttcagcactaggatgtcttccccaggctggtgagcaggagattttgctcttgtgttgagacccgcagttaacgcttggtgttctggcctgcacgcagtgtgtggcaagttccctgagtttacctcggcggcgatgcctccgcctggagctggaggggcagcgtgccctggggctgctgaaaaactcaggcctgtggagtcagaacccgctcttcagcaggtcccaggccacttgagtgtggaaggctgcccggggcactggcagcctctgggggaagcctgctcccaagccgtctaggagccgagcacgctgtaccgccagccccagccctgcctgcatgaggggcccggcacgcttgtgcagcaacgctgcttacactatgaaggccaaggctggcccggttctggtgttgcattcgagggctgtgaacagaatgaaatgtcaacatccatttttcagacttgttctgcctccgaagagatttttagtgctgagtgattttcactattaacatatggctggaaggaatggttttcttatcttctccgagctctagactggctagcttctctctggctttttttgttttgttttcctctctttagaattgctgtatacttgtatctcctcagcacatttagaaaagccagtgtataattttggctggcaactgacggacgcagcgggcagcagcaggcagggcagcgcacgagagcacctcccagggcacggtgggaaactggccagcccagccccactactgccctctcctgctcgtccccagtccctgagctacaggtggctgtaggcagaagcccaccgggtgttccttagcgacagacaggtcgtcagctgctccccttgatgccttttcacagaaacaaccctcaacttgaggaagttgagagctccactccgaggtggacttgctccccctccctgagagctaactggcttgaactgtcatgagttcctggctgcccacaaagagggaccttctccacccttgtcctctgcgtggggcggacatcagccagacatgtcaccgacctgattgggggcagggagtaggaagtccaggaccaaaccatgctccccatgacagcagctggcgcctcagtccccatctgactcatgtctcttctcatctggttcagaacttagaagggcgtggcctctgatcagctggttccctccaaaccccagtggcaacctgtcccttgagagccaggaatggctcttagcagtgggcagtgagcccccgagaggataaagcggctgctcgaacagattgcgagcacattacttgctgcatgggaggaggtttaaaacaaatcaaagattccttgagggcattttacagaaaacaagatgtcaagagcatcactgttgttatttaaaagcccatttgaggccaggcgcggtggctcacgtctgtaatcccagcactttgggaggccgaggcggacggatcacgaggtcaggagatcgagaccatcctggctaacatggtgaaacccccgtctctactaaaaatacaaaaaattagccgggtgtggtggctggcgcctgtagtcccagctactcggaaggctaaggcaggagaatggcgtgaacctgggaggcagagcttgcagtgagccaagatcgcgccactgcactccagcctgggcgacacagcaagactccgtctcg

SEQ ID NO: 316829 - DNA, 2075 bp, Homo sapiens
cggcgctcgctcgccggcgccatccctatagagaagaacggaggtacggcctgtggtcatggcgctgttcccagcctttgcggggcttagtgaggctcccgatggcgggagctccaggaaagagttagactggctgagcaacccaagcttttgtgttggatccataacgtccctgagccaacaaactgaagcagctccagcccatgtttctgaagggttaccgctgacaaggagtcatctgaaatcagagtcttcagatgaaagtgacactaacaaaaagctcaaacaaacaagtagaaaaaagaagaaagagaaaaagaaaaaaaggaagcatcagcatcataagaaaacaaagaggaagcatgggccgtcgagtagcagcaggtctgagacagacaccgattctgaaaaggacaaaccttccagaggcgttggaggcagtaaaaaggaatctgaggaaccgaatcaaggaaataatgctgcagctgatactggacatcgctttgtttggcttgaggacattcaggctgtgacgggagaaaccttcagaacagataagaaaccagatcctgcgaactgggagtacaagtctctctaccgaggggatatagcaagatacaagaggaaaggagactcctgccttggcattaaccctaagaagcagtgcatatcttgggaagggacttccacagagaagaagcattcacgcaagcaggttgaacgctattttactaagaagagtgtgggattaatgaacatcgatggagttgccattagcagtaaaactgaacctccctcatctgagcccatctcctttataccagtgaaggacttggaagatgcggctcctgttacaacctggttgaatcctctggggatttatgatcagtcaaccacacattggctacaaggacagggtcctccagagcaggaatcaaagcagccagacgcacagccagacagcgagagtgcggctctcaaggccaaggtggaggagtttaacaggagggtgcgggagaatcctcgggatacgcagctgtggatggcatttgttgcttttcaggacgaggtcatgaaaagtcctggcctgtatgccatcgaggaaggagagcaggaaaagcgaaagaggtccctgaagctcattctggagaagaagctggccattctggagcgggccattgagagcaaccagagcagtgtggatctgaaactggccaagctgaagctctgcacagagttctgggagccctccactctggtcaaagagtggcagaaactgatatttttgcatcccaataatacagccctttggcagaaataccttttattttgccagagccagtttagtaccttttcgatatcaaaaattcacagtctttatggaaaatgcttgagcactttgtctgctgttaaggacggcagcatcttatctcaccctgcgttgcctggcacggaagaggccatgtttgcactctttcttcagcagtgccactttctgcggcaggctggccactctgagaaggccatctcattgttccaggccatggtggacttcaccttcttcaaacccgacagcgtaaaagatctgcctaccaaaggacaggtggaattctttgaacccttttgggacagtggagagccccgggctggggagaagggagcccgaggctggaaggcgtggatgcaccagcaggaacgaggtggctgggtggtcatcaacccagatgaggatgacgatgaaccagaagaggatgaccaggaaataaaagataagactgctgctggaggattagagagcagcgggaaaacgggctgtgcctgcgaggccaagttgcccaccctgcggagctaggaggcgcgagcagagaacgtgtgtgttaggagaactcggcttttgaaatgttctttctcgatagtaataatgtgggctgccagcctctcacatcttgcacactttttgggtgtgtaaatgacacaaaagttatttacatattatatatgtgaatatgtgtatatatgtacatagccagagagtcatgccacgtggtcattaaaccgatgatgattgaggcgtg

SEQ ID NO: 316830 - DNA, 1884 bp, Homo sapiens
cggcgctcgctcgccggcgccatccctatagagaagaacggaggtacggcctgtggtcatggcgctgttcccagcctttgcggggcttagtgaggctcccgatggcgggagctccaggaaagagttagactggctgagcaacccaagcttttgtgttggatccataacgtccctgagccaacaaactgaagcagctccagcccatgtttctgaagggttaccgctgacaaggagtcatctgaaatcagagtcttcagatgaaagtgacactaacaaaaagctcaaacaaacaagtagaaaaaagaagaaagagaaaaagaaaaaaaggaagcatcagcatcataagaaaacaaagaggaagcatgggccgtcgagtagcagcaggtctgagacagacaccgattctgaaaaggacaaaccttccagaggcgttggaggcagtaaaaaggaatctgaggaaccgaatcaaggaaataatgctgcagctgatactggacatcgctttgtttggcttgaggacattcaggctgtgacgggagaaaccttcagaacagataagaaaccagatcctgcgaactgggagtacaagtctctctaccgaggggatatagcaagatacaagaggaaaggagactcctgccttggcattaaccctaagaagcagtgcatatcttgggaagggacttccacagagaagaagcattcacgcaagcaggttgaacgctattttactaagaagagtgtgggattaatgaacatcgatggagttgccattagcagtaaaactgaacctccctcatctgagcccatctcctttataccagtgaaggacttggaagatgcggctcctgttacaacctggttgaatcctctggggatttatgatcagtcaaccacacattggctacaaggacagggtcctccagagcaggaatcaaagcagccagacgcacagccagacagcgagagtgcggctctcaaggccaaggtggaggagtttaacaggagggtgcgggagaatcctcgggatacgcagctgtggatggcatttgttgcttttcaggacgaggtcatgaaaagtcctggcctgtatgccatcgaggaaggagagcaggaaaagcgaaagaggtccctgaagctcattctggagaagaagctggccattctggagcgggccattgagagcaaccagagcagtgtggatctgaaactggccaagctgaagctctgcacagagttctgggagccctccactctggtcaaagagtggcagaaactgatatttttgcatcccaataatacagccctttggcagaaataccttttattttgccagagccagtttagtaccttttcgatatcaaaaattcacagtctttatggaaaatgcttgagcactttgtctgctgttaaggacggcagcatcttatctcaccctgcgttgcctggcacggaagaggccatgtttgcactctttcttcagcagtgccactttctgcggcaggctggccactctgagaaggccatctcattgttccaggccatggtggacttcaccttcttcaaacccgacagcgtaaaagatctgcctaccaaaggacaggtggaattctttgaacccttttgggacagtggagagccccgggctggggagaagggagcccgaggctggaaggcgtggatgcaccagcaggaacgaggtggctgggtggtcatcaacccagatgaggatgacgatgaaccagaagaggatgaccaggaaataaaagataagactctgcccaggtggcagatctggcttgctgctgagcgttcccgtgaccagaggcactggcggccctggcgccctgataagaccaagaattatcaataaaaaaataaatt

SEQ ID NO: 316831 - DNA, 624 bp, Homo sapiens
  misc_feature (594)..(594): n is a, c, g, or t
  misc_feature (599)..(599): n is a, c, g, or t
  misc_feature (607)..(608): n is a, c, g, or t
cggcgctcgctcgccggcgccatccctatagagaagaacggaggtacggcctgtggtcatggcgctgttcccagcctttgcggggcttagtgaggctcccgatggcgggagctccaggaaagagttagactggctgagcaacccaagcttttgtgttggatccataacgtccctgagccaacaaactgaagcagctccagcccatgtttctgaagggttaccgctgacaaggagtcatctgaaatcagagtcttcagatgaaagtgacactaacaaaaagctcaaacaaacaagtagaaaaaagaagaaagagaaaaagaaaaaaaggaagcatcagcatcataagaaaacaaagaggaagcatgggccgtcgagtagcagcaggtctgagacagacaccgattctgaaaaggacaaaccttccagaggcgttggaggcagtaaaaaggaatctgaggaaccgaatcaaggaaataatgctgcagctgatactggacatcgctttgtttggcttgaggacattcaggctgtgacgggagaaaccttcagatgaaagtgacactaacaaaaagctcaaacaaacaagttgaaaanagaanaaagagannaagaaaaaaaggaagc

SEQ ID NO: 316832 - DNA, 96 bp, Homo sapiens
tttacatagtattatttttcctacatctttttagaaagtaattttaaagttgattttcccaaacaggagtcatctgaaatcagagtcttcagatga

SEQ ID NO: 316833 - DNA, 281 bp, Homo sapiens
agaaagagaaaaagaaaaaaaggaagcatcagcatcataagaaaacaaagaggaagcatgggccgtcgagtagcagcaggtctgagacagacaccgattctgaaaaggacaaaccttccagaggcgttggaggcagtaaaaaggaatctgaggaaccgaagtaggttgctgttctcaagcacctatgatattttaagtcttgagtttttctcccttaattgttgccgcaaattagatatttgaataaccatttagtcactcagtcggaagagagctctacc

SEQ ID NO: 316834 - DNA, 5653 bp, Homo sapiens
cggcgctcgctcgccggcgccatccctatagagaagaacggaggtacggcctgtggtcatggcgctgttcccagcctttgcggggcttagtgaggctcccgatggcgggagctccaggaaagagttagactggctgagcaacccaagcttttgtgttggatccataacgtccctgagccaacaaactgaagcagctccagcccatgtttctgaagggttaccgctgacaaggagtcatctgaaatcagagtcttcagatgaaagtgacactaacaaaaagctcaaacaaacaagtagaaaaaagaagaaagagaaaaagaaaaaaaggaagcatcagcatcataagaaaacaaagaggaagcatgggccgtcgagtagcagcaggtctgagacagacaccgattctgaaaaggacaaaccttccagaggcgttggaggcagtaaaaaggaatctgaggaaccgaatcaaggaaataatgctgcagctgatactggacatcgctttgtttggcttgaggacattcaggctgtgacgggagaaaccttcagaacagataagaaaccagatcctgcgaactgggagtacaagtctctctaccgaggggatatagcaagatacaagaggaaaggagactcctgccttggcattaaccctaagaagcagtgcatatcttgggaagggacttccacagagaagaagcattcacgcaagcaggttgaacgctattttactaagaagagtgtgggattaatgaacatcgatggagttgccattagcagtaaaactgaacctccctcatctgagcccatctcctttataccagtgaaggacttggaagatgcggctcctgttacaacctggttgaatcctctggggatttatgatcagtcaaccacacattggctacaaggacagggtcctccagagcaggaatcaaagcagccagacgcacagccagacagcgagagtgcggctctcaaggccaaggtggaggagtttaacaggagggtgcgggagaatcctcgggatacgcagctgtggatggcatttgttgcttttcaggacgaggtcatgaaaagtcctggcctgtatgccatcgaggaaggagagcaggaaaagcgaaagaggtccctgaagctcattctggagaagaagctggccattctggagcgggccattgagagcaaccagagcagtgtggatctgaaactggccaagctgaagctctgcacagagttctgggagccctccactctggtcaaagagtggcagaaactgatatttttgcatcccaataatacagccctttggcagaaataccttttattttgccagagccagtttagtaccttttcgatatcaaaaattcacagtctttatggaaaatgcttgagcactttgtctgctgttaaggacggcagcatcttatctcaccctgcgttgcctggcacggaagaggccatgtttgcactctttcttcagcagtgccactttctgcggcaggctggccactctgagaaggccatctcattgttccaggccatggtggacttcaccttcttcaaacccgacagcgtaaaagatctgcctaccaaaggacaggtggaattctttgaacccttttgggacagtggagagccccgggctggggagaagggagcccgaggctggaaggcgtggatgcaccagcaggaacgaggtggctgggtggtcatcaacccagatgaggatgacgatgaaccagaagaggatgaccaggaaataaaagataagactctgcccaggtggcagatctggcttgctgctgagcgttcccgtgaccagaggcactggcggccctggcgccctgataagaccaagaagcaaaccgaggaagactgtgaggatcccgagagacaggtgttgtttgatgatattgggcaatctttgatcagactttccagccatgatcttcagttccagctggtggaggccttcctgcagttcttgggtgtgccttctggctttactcctccagcctcctgtctttatctggccatggatgagaacagcatctttgataatggactttatgatgaaaagcccttgacttttttcaaccctttgttttctggggctagctgtgttggccgcatggataggttgggctatcctcgctggaccaggggtcagaaccgagagggcgaggagttcatccgcaatgtcttccaccttgtcatgcctttattttcaggcaaagagaagtcccagctctgcttctcctggttacagtatgagattgcaaaggtcatttggtgcctgcacactaaaaacaagaagagattaaagtctcaagggaagaactgcaaaaaactagccaagaatctccttaaggagccagaaaactgcaacaacttttgcctgtggaagcagtatgcacatctggagtggttgcttggcaacacggaggatgccagaaaagtttttgacacagcacttggcatggcaggaagcagagaactgaaagactctgacctctgtgagctcagtctgctctatgctgagctggaggtggagctgtcgccagaagtgagaagggctgccacagctcgagctgttcacatattaaccaagctgactgagagcagcccctatgggccctacactggacaggtgttggctgttcacattttgaaagcgcgaaaggcttatgagcacgcactgcaggactgtttgggtgacagctgtgtctccaatccagctcccaccgattcctgtagccgcctaattagcctggctaaatgcttcatgctcttccagtatttgaccatagggattgatgctgctgtgcagatatacgaacaggtgtttgcaaaactgaacagttctgttttcccagaaggctctggcgagggggacagtgccagctcccagagttggaccagtgttctcgaagccatcacactgatgcacacgagcctgctgagattccacatgaaagtgagtgtttacccgctggcccctctgcgagaggcactctcacaggctttaaagttgtatccaggcaaccaggttctttggaggtcctatgtacagattcagaataagtcccacagtgccagcaaaaccaggagattttttgacacaatcaccaggtctgccaaacccttggagccttggttgtttgcaattgaagctgagaaactgaggaagagactggtggaaactgtccagaggttagacggtagagagatccacgccacaattcctgagaccggcttaatgcatcggatccaagccctgtttgaaaatgccatgcgcagcgacagtggcagccagtgccccttgctgtggaggatgtatttgaactttctggtttccttaggaaataaagaaagaagcaaaggtgtattctacaaagcacttcagaattgcccttgggcaaaggtgttgtacctggacgccgtggagtatttccccgatgagatgcaggagatcctggacctgatgactgagaaggagctccgggtgcgcctgccgctggaggagctggagctgctgctggaggattagagagcagcgggaaaacgggctgtgcctgcgaggccaagttgcccaccctgcggagctaggaggcgcgagcagagaacgtgtgtgttaggagaactcggcttttgaaatgttctttctcgatagtaataatgtgggctgccagcctctcacatcttgcacactttttgggtgtgtaaatgacacaaaagttatttacatattatatatgtgaatatgtgtatatatgtacatagccagagagtcatgccacgtggtcattaaaccgatgatgattgaggcgtggcagcgtccttgctcattctctccctgtgcgcagccagcactggcccccgcacggtgaatgtgttccctccgctggtgtcgtggtggtcctgccaggccctctctgagataaaggtctggtttttcagcactaggatgtcttccccaggctggtgagcaggagattttgctcttgtgttgagacccgcagttaacgcttggtgttctggcctgcacgcagtgtgtggcaagttccctgagtttacctcggcggcgatgcctccgcctggagctggaggggcagcgtgccctggggctgctgaaaaactcaggcctgtggagtcagaacccgctcttcagcaggtcccaggccacttgagtgtggaaggctgcccggggcactggcagcctctgggggaagcctgctcccaagccgtctaggagccgagcacgctgtaccgccagccccagccctgcctgcatgaggggcccggcacgcttgtgcagcaacgctgcttacactatgaaggccaaggctggcccggttctggtgttgcattcgagggctgtgaacagaatgaaatgtcaacatccatttttcagacttgttctgcctccgaagagatttttagtgctgagtgattttcactattaacatatggctggaaggaatggttttcttatcttctccgagctctagactggctagcttctctctggctttttttgttttgttttcctctctttagaattgctgtatacttgtatctcctcagcacatttagaaaagccagtgtataattttggctggcaactgacggacgcagcgggcagcagcaggcagggcagcgcacgagagcacctcccagggcacggtgggaaactggccagcccagccccactactgccctctcctgctcgtccccagtccctgagctacaggtggctgtaggcagaagcccaccgggtgttccttagcgacagacaggtcgtcagctgctccccttgatgccttttcacagaaacaaccctcaacttgaggaagttgagagctccactccgaggtggacttgctccccctccctgagagctaactggcttgaactgtcatgagttcctggctgcccacaaagagggaccttctccacccttgtcctctgcgtggggcggacatcagccagacatgtcaccgacctgattgggggcagggagtaggaagtccaggaccaaaccatgctccccatgacagcagctggcgcctcagtccccatctgactcatgtctcttctcatctggttcagaacttagaagggcgtggcctctgatcagctggttccctccaaaccccagtggcaacctgtcccttgagagccaggaatggctcttagcagtgggcagtgagcccccgagaggataaagcggctgctcgaacagattgcgagcacattacttgctgcatgggaggaggtttaaaacaaatcaaagattccttgagggcattttacagaaaacaagatgtcaagagcatcactgttgttatttaaaagcccatttgaggccaggcgcggtggctcacgtctgtaatcccagcactttgggaggccgaggcggacggatcacgaggtcaggagatcgagaccatcctggctaacatggtgaaacccccgtctctactaaaaatacaaaaaattagccgggtgtggtggctggcgcctgtagtcccagctactcggaaggctaaggcaggagaatggcgtgaacctgggaggcagagcttgcagtgagccaagatcgcgccactgcactccagcctgggcgacacagcaagactccgtctcg

SEQ ID NO: 316835 - DNA, 5632 bp, Homo sapiens
cggcgctcgctcgccggcgccatccctatagagaagaacggaggtacggcctgtggtcatggcgctgttcccagcctttgcggggcttagtgaggctcccgatggcgggagctccaggaaagagttagactggctgagcaacccaagcttttgtgttggatccataacgtccctgagccaacaaactgaagcagctccagcccatgtttctgaagggttaccgctgacaaggagtcatctgaaatcagagtcttcagatgaaagtgacactaacaaaaagctcaaacaaacaagtagaaaaaagaagaaagagaaaaagaaaaaaaggaagcatcagcatcataagaaaacaaagaggaagcatgggccgtcgagtagcagcaggtctgagacagacaccgattctgaaaaggacaaaccttccagaggcgttggaggcagtaaaaaggaatctgaggaaccgaatcaaggaaataatgctgcagctgatactggacatcgctttgtttggcttgaggacattcaggctgtgacgggagaaaccttcagaacagataagaaaccagatcctgcgaactgggagtacaagtctctctaccgaggggatatagcaagatacaagaggaaaggagactcctgccttggcattaaccctaagaagcagtgcatatcttgggaagggacttccacagagaagaagcattcacgcaagcaggttgaacgctattttactaagaagagtgtgggattaatgaacatcgatggagttgccattagcagtaaaactgaacctccctcatctgagcccatctcctttataccagtgaaggacttggaagatgcggctcctgttacaacctggttgaatcctctggggatttatgatcagtcaaccacacattggctacaaggacagggtcctccagagcaggaatcaaagcagccagacgcacagccagacagcgagagtgcggctctcaaggccaaggtggaggagtttaacaggagggtgcgggagaatcctcgggatacgcagctgtggatggcatttgttgcttttcaggacgaggtcatgaaaagtcctggcctgtatgccatcgaggaaggagagcaggaaaagcgaaagaggtccctgaagctcattctggagaagaagctggccattctggagcgggccattgagagcaaccagagcagtgtggatctgaaactggccaagctgaagctctgcacagagttctgggagccctccactctggtcaaagagtggcagaaactgatatttttgcatcccaataatacagccctttggcagaaataccttttattttgccagagccagtttagtaccttttcgatatcaaaaattcacagtctttatggaaaatgcttgagcactttgtctgctgttaaggacggcagcatcttatctcaccctgcgttgcctggcacggaagaggccatgtttgcactctttcttcagcagtgccactttctgcggcaggctggccactctgagaaggccatctcattgttccaggccatggtggacttcaccttcttcaaacccgacagcgtaaaagatctgcctaccaaaggacaggtggaattctttgaacccttttgggacagtggagagccccgggctggggagaagggagcccgaggctggaaggcgtggatgcaccagcaggaacgaggtggctgggtggtcatcaacccagatgaggatgacgatgaaccagaagaggatgaccaggaaataaaagataagactctgcccaggtggcagatctggcttgctgctgagcgttcccgtgaccagaggcactggcggccctggcgccctgataagaccaagaagcaaaccgaggaagactgtgaggatcccgagagacaggtgttgtttgatgatattgggcaatctttgatcagactttccagccatgatcttcagttccagctggtggaggccttcctgcagttcttgggtgtgccttctggctttactcctccagcctcctgtctttatctggccatggatgagaacagcatctttgataatggactttatgatgaaaagcccttgacttttttcaaccctttgttttctggggctagctgtgttggccgcatggataggttgggctatcctcgctggaccaggggtcagaaccgagagggcgaggagttcatccgcaatgtcttccaccttgtcatgcctttattttcaggcaaagagaagtcccagctctgcttctcctggttacagtatgagattgcaaaggtcatttggtgcctgcacactaaaaacaagaagagattaaagtctcaagggaagaactgcaaaaaactagccaagaatctccttaaggagccagaaaactgcaacaacttttgcctgtggaagcagtatgcacatctggagtggttgcttggcaacacggaggatgccagaaaagtttttgacacagcacttggcatggcaggaagcagagaactgaaagactctgacctctgtgagctcagtctgctctatgctgagctggaggtggagctgtcgccagaagtgagaagggctgccacagctcgagctgttcacatattaaccaagctgactgagagcagcccctatgggccctacactggacaggtgttggctgttcacattttgaaagcgcgaaaggcttatgagcacgcactgcaggactgtttgggtgacagctgtgtctccaatccagctcccaccgattcctgtagccgcctaattagcctggctaaatgcttcatgctcttccagtatttgaccatagggattgatgctgctgtgcagatatacgaacaggtgtttgcaaaactgaacagttctgttttcccagaaggctctggcgagggggacagtgccagctcccagagttggaccagtgttctcgaagccatcacactgatgcacacgagcctgctgagattccacatgaaagtgagtgtttacccgctggcccctctgcgagaggcactctcacaggctttaaagttgtatccaggcaaccaggttctttggaggtcctatgtacagattcagaataagtcccacagtgccagcaaaaccaggagattttttgacacaatcaccaggtctgccaaacccttggagccttggttgtttgcaattgaagctgagaaactgaggaagagactggtggaaactgtccagaggttagacggtagagagatccacgccacaattcctgagaccggcttaatgcatcggatccaagccctgtttgaaaatgccatgcgcagcgacagtggcagccagtgccccttgctgtggaggatgtatttgaactttctggtttccttaggaaataaagaaagaagcaaaggtgtattctacaaagcacttcagaattgcccttgggcaaaggtgttgtacctggacgccgtggagtatttccccgatgagatgcaggagatcctggacctgatgactgagaaggagctccgggtgcgcctgctgctggaggattagagagcagcgggaaaacgggctgtgcctgcgaggccaagttgcccaccctgcggagctaggaggcgcgagcagagaacgtgtgtgttaggagaactcggcttttgaaatgttctttctcgatagtaataatgtgggctgccagcctctcacatcttgcacactttttgggtgtgtaaatgacacaaaagttatttacatattatatatgtgaatatgtgtatatatgtacatagccagagagtcatgccacgtggtcattaaaccgatgatgattgaggcgtggcagcgtccttgctcattctctccctgtgcgcagccagcactggcccccgcacggtgaatgtgttccctccgctggtgtcgtggtggtcctgccaggccctctctgagataaaggtctggtttttcagcactaggatgtcttccccaggctggtgagcaggagattttgctcttgtgttgagacccgcagttaacgcttggtgttctggcctgcacgcagtgtgtggcaagttccctgagtttacctcggcggcgatgcctccgcctggagctggaggggcagcgtgccctggggctgctgaaaaactcaggcctgtggagtcagaacccgctcttcagcaggtcccaggccacttgagtgtggaaggctgcccggggcactggcagcctctgggggaagcctgctcccaagccgtctaggagccgagcacgctgtaccgccagccccagccctgcctgcatgaggggcccggcacgcttgtgcagcaacgctgcttacactatgaaggccaaggctggcccggttctggtgttgcattcgagggctgtgaacagaatgaaatgtcaacatccatttttcagacttgttctgcctccgaagagatttttagtgctgagtgattttcactattaacatatggctggaaggaatggttttcttatcttctccgagctctagactggctagcttctctctggctttttttgttttgttttcctctctttagaattgctgtatacttgtatctcctcagcacatttagaaaagccagtgtataattttggctggcaactgacggacgcagcgggcagcagcaggcagggcagcgcacgagagcacctcccagggcacggtgggaaactggccagcccagccccactactgccctctcctgctcgtccccagtccctgagctacaggtggctgtaggcagaagcccaccgggtgttccttagcgacagacaggtcgtcagctgctccccttgatgccttttcacagaaacaaccctcaacttgaggaagttgagagctccactccgaggtggacttgctccccctccctgagagctaactggcttgaactgtcatgagttcctggctgcccacaaagagggaccttctccacccttgtcctctgcgtggggcggacatcagccagacatgtcaccgacctgattgggggcagggagtaggaagtccaggaccaaaccatgctccccatgacagcagctggcgcctcagtccccatctgactcatgtctcttctcatctggttcagaacttagaagggcgtggcctctgatcagctggttccctccaaaccccagtggcaacctgtcccttgagagccaggaatggctcttagcagtgggcagtgagcccccgagaggataaagcggctgctcgaacagattgcgagcacattacttgctgcatgggaggaggtttaaaacaaatcaaagattccttgagggcattttacagaaaacaagatgtcaagagcatcactgttgttatttaaaagcccatttgaggccaggcgcggtggctcacgtctgtaatcccagcactttgggaggccgaggcggacggatcacgaggtcaggagatcgagaccatcctggctaacatggtgaaacccccgtctctactaaaaatacaaaaaattagccgggtgtggtggctggcgcctgtagtcccagctactcggaaggctaaggcaggagaatggcgtgaacctgggaggcagagcttgcagtgagccaagatcgcgccactgcactccagcctgggcgacacagcaagactccgtctcg

SEQ ID NO: 316836 - DNA, 716 bp, Homo sapiens
  misc_feature (686)..(686): n is a, c, g, or t
  misc_feature (691)..(691): n is a, c, g, or t
  misc_feature (699)..(700): n is a, c, g, or t
cggcgctcgctcgccggcgccatccctatagagaagaacggaggtacggcctgtggtcatggcgctgttcccagcctttgcggggcttagtgaggctcccgatggcgggagctccaggaaagagttagactggctgagcaacccaagcttttgtgttggatccataacgtccctgagccaacaaactgaagcagctccagcccatgtttctgaagggttaccgctgacaaggagtcatctgaaatcagagtcttcagatgaaagtgacactaacaaaaagctcaaacaaacaagtagaaaaaagaagaaagagaaaaagaaaaaaaggaagcatcagcatcataagaaaacaaagaggaagcatgggccgtcgagtagcagcaggtctgagacagacaccgattctgaaaaggacaaaccttccagaggcgttggaggcagtaaaaaggaatctgaggaaccgaatcaaggaaataatgctgcagctgatactggacatcgctttgtttggcttgaggacattcaggctgtgacgggagaaaccttcagaacagataagaaaccagatcctgcgaactgggagtacaagtctctctaccgaggggatatagcaaggagtcatctgaaatcaaagtcttcagatgaaagtgacactaacaaaaagctcaaacaaacaagttgaaaanagaanaaagagannaagaaaaaaaggaagc

SEQ ID NO: 316837 - DNA, 319 bp, Homo sapiens
tgatataatcatttatcttgtttcccattaaaatatgtggttgaaagtaatgggttcaaaatacctatgtaataaatcaatgaaaaatgaattaaccaactcacagattgcctaagaattatgtgatgatgaaattgtatgcttatataaggaactggacttaatatatatttgtgatgatatctaccactttattcctttattaggaaaaattaagtgcactccaatttattcatccattctttcattaaaaaaccgttttctgggcatttcctaaatccacagcactatcccgtgcaaaaaaggggactgaaggagc

SEQ ID NO: 316838 - DNA, 2159 bp, Homo sapiens
acacacagccattgggggttgctcggatccgggactgccgcagggggtgccacagcagtgcctggcagcgtgggctgggaccttgtcactaaagcagagaagccacttcttctgggcccacgaggcagctgtcccatgctctgctgagcacggtggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggaagatggagctcccccatcccacacgcactgcactgccattgtcttttggttgccatggtcaccaaacaggaagtggacattctaagggaggagtactgaagagtgacggacttctgaggctgtttcctgctgctcctctgacttggggcagcttgggtcttcttgggcacctctctgggaaaacccagggtgaggttcagcctgtgagggctgggatgggtttcgtgggcccaagggcagacctttctttgggactgtgtggaccaaggagcttccatctagtgacaagtgacccccagctatcgcctcttgccttcccctgtggccactttccagggtggactctgtcttgttcactgcagtatcccaactgcaggtccagtgcaggcaataaatatgtgatggaca

SEQ ID NO: 316839 - DNA, 549 bp, Homo sapiens
cctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgtggccactttccagggtggactctgtcttgttcactgcagtatcccaactgcaggtccagtgcaggcaataaatatgtgatggaca

SEQ ID NO: 316840 - DNA, 2528 bp, Homo sapiens
acacacagccattgggggttgctcggatccgggactgccgcagggggtgccacagcagtgcctggcagcgtgggctgggaccttgtcactaaagcagagaagccacttcttctgggcccacgaggcagctgtcccatgctctgctgagcacggtggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggaagatggagctcccccatcccacacgcactgcactgccattgtcttttggttgccatggtcaccaaacaggaagtggacattctaagggaggagtactgaagagtgacggacttctgaggctgtttcctgctgctcctctgacttggggcagcttgggtcttcttgggcacctctctgggaaaacccagggtgaggttcagcctgtgagggctgggatgggtttcgtgggcccaagggcagacctttctttgggactgtgtggaccaaggagcttccatctagtgacaagtgacccccagctatcgcctcttgccttcccctgtggccactttccagggtggactctgtcttgttcactgcagtatcccaactgcaggtccagtgcaggcaataaatatgtgatggacaaacgatagcggaatccttcaaggtttcaaggctgtctccttcaggcagccttcccggaattctccatccctcagtgcaggatgggggctggtcctcagctgtctgccctcagcccctggccccccaggaagcctctttcatgggctgttaggttgacttcagttttgcctcttggacaacagggggtcttgtacatccttgggtgaccaggaaaagttcaggctatggggggccaaagggagggctgccccttccccaccagtgaccactttattccacttcctccattacccagttttggcccacagagtttggtcccccccaaacctcggaccaatatccctctaaacatcaatctatcctcctgtt

SEQ ID NO: 316841 - DNA, 2189 bp, Homo sapiens
acacacagccattgggggttgctcggatccgggactgccgcagggggtgccacagcagtgcctggcagcgtgggctgggaccttgtcactaaagcagagaagccacttcttctgggcccacgaggcagctgtcccatgctctgctgagcacggtggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactcaaccagtgcccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggaagatggagctcccccatcccacacgcactgcactgccattgtcttttggttgccatggtcaccaaacaggaagtggacattctaagggaggagtactgaagagtgacggacttctgaggctgtttcctgctgctcctctgacttggggcagcttgggtcttcttgggcacctctctgggaaaacccagggtgaggttcagcctgtgagggctgggatgggtttcgtgggcccaagggcagacctttctttgggactgtgtggaccaaggagcttccatctagtgacaagtgacccccagctatcgcctcttgccttcccctgtggccactttccagggtggactctgtcttgttcactgcagtatcccaactgcaggtccagtgcaggcaataaatatgtgatggaca

SEQ ID NO: 316842 - DNA, 2265 bp, Homo sapiens
gaattccgttgctgtcgccgttgctgtcgattttatttgtatcaactcaaagcaaaatagagcattttattaaatatgtcttcataaattacgcacagtaaaatcccattaattggaccacacccagttcattatagtgtttattataattttagcattagttgaactgaaaattggtttttgtttactatgagaaaaaggtagactaaacaagataaaacctgttgtttgcatattatgtttgtacatctttattagcaactatttttccaactattttcaactatttttccaactattttctagttataaaagcaatacataaatactatagaaaatttagcaatgcagaaaggaatttttaaaaatccctcatagattagccattgttaacattttggtgtatttccttcaagtcttagtaaaatgtgaacctttaaatatagatccctgtatcttaggaattagaaaggcagcaaaggcagttcctaatgagatggagaaaatgttgatttagtcatgcccttgtactgtgggggccatactgtctgttgacagagcatattaaaagacgttccctacattcgtcagccttagctaattggcagtctggtatttatgattttatattttgttatcagcttgggagctgcagtaccccccagcctcctagaaaaacttggcttccctagctgggaggcctcgttccaggagtcgttgttgagagtcaagccagggaagtgtgtttttttcagggagcagccagtcctgtgctgggagcatcttcagggggcacctgccgttgaattgttctcacttgtcgtttgtaagaatccaagtatgtcacccttacaccaagtgagtcacacagtgacacaatcccctttcaatgtagataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggtaagtgcctccaaatttcatgagctgacgttctattacaaaataagcagcgtgcttatgaaactgtgttgcagaggtaagagccctccctgccttgttaaagagaagaaaggaggaagccgcagtattgcctgtgctgctcgagtaggtcttgggtggagtcatggttctccattcttaggaggttgctgtttggaaaacagagatgttatcacccttactggattttgcctcatcagtcaagggttgcgttgtctgactgtgaccagtcagacggcagacgggggtgcgcttagggcttttctgccaagaatgacagcagttggtctggagtgctcacctccctgtgaaatcattgttagcgcgaccctcatctgcctcaggatgctgtactcactacgcacaactgctccatctttaagatattggagtgagagcacgggaggagcatgggcggttcgttttgttagaaagaaacccggattcacgagatggtttttattgattagtttacaggatttgcactattgatagagtttttgccttggcacaggcctgctttgtgataggggttttaaaataaccgtgggcttttcactggaggataaaagccggtgcttattgcatgcacaattgctttccagccgtcagcctgtgtgtacctttgcatatgtacttttctctttaaactctcccttttaaatacgactcttgccaggctttaagtgaatgcttcaaaataaaaggagttatcaattaaagagtgaattccttccaaagagaatttgggaaaataatttaggaaaagaagaggcgagaaggtcatgggaaaggttgtctttgctgatttatctgccccaactggataaagttactgcataagggtttctttacagcctccctgtttttctcagactaactcttggtcagtcttaaattcttaaaattccatcatctgatagagctaacgagagcgggcagctcttcattccatccttgaaaagcacagtgtcctccccactggggaacaccaatccttaaaaaacttctttctcattgcaaatcgaaggaggctgccgctgcacccagccccagactcctcagtcacttacctggcaagctgaggccctaccagtttaaggtgatgattattgtttcttgtattaaattttaaaatgaatttttctccgctttttttttttctaagtaggtttgtgtttctgga

SEQ ID NO: 316843 - DNA, 929 bp, Homo sapiens
gtagggaagttggtgccggggcgggctccgcggttcccgggccccgcgacccgcacctcgccccttccgtgcgcacgagcctctccgcacacagcgctgatccccctgcggcgcgcaggcagcagcgacagcaccctgggccgcaccgcgtctccgctgctggggctgaccgggcagtggggagcgggcagccgcccggcccgcggggtgcgagttgccctcgaggggggaggtgccctgcggagaggccccgaagccccaggacacgtctccaagcgcccgtcgctgcctcccgtcgcccaacgtgcttttgcccctcgggctcctcgggttcctggccttgcccgtcactttggcccgctcctcgttgggttacctgcccccggcgtcccggggctgggcggtggggtgaggggaagcgctctctgggcagccccccgggaagtgcgaggccgggagtcttcctcagcttgtctcttccggggagcgccactgggtccccagttcagagggctctgggatggtctcccagtttctcccgggccgggggatggaggggtactagggccgcatccgagtgtgcgttggtgggtgtgtggtcggagccgacgtgcattccgacacacgtgctcgcagcgcggggtgtagtcgccgcctcacggggacacctagacgcccgtccctggcgagaggtgtcgtacgctgtggtttcagcgccagggtctgcggcggcgcggggagggtgttgtgttttgcgagcgcggagccctggccttggttttgttgtggtcggcgtcgtcgtcgccctctcttctgccgccccgcacttcctttgtacgtagttaataagcagtgtcgctccacattcgctgtcttttgcaatctgatagcttttgttttggtggtgtcgggtgggggttagtagggaa

SEQ ID NO: 316844 - DNA, 6579 bp, Homo sapiens
  misc_feature (10)..(12): n is a, c, g, or t
tttttttttnnntttatgtcccccccccatccccccggcaattatacctaaatatggtgttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagtctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgagtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaa

SEQ ID NO: 316845 - DNA, 6564 bp, Homo sapiens
  misc_feature (10)..(12): n is a, c, g, or t
tttttttttnnntttatgtcccccccccatccccccggcaattatacctaaatatggtgttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagtctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaa

SEQ ID NO: 316846 - DNA, 4717 bp, Homo sapiens
ctcctaacctcaggtgatttgcccgcctcggcctcccaaagtgctgggattatagccttgagccaccacatctggccgagaccagctatcttcttgattaaaggtactgagagctattatttttccttacaagcatgtataacggctttcattcccactcttgttttggcttttcttttccgagaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagtctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaa

SEQ ID NO: 316847 - DNA, 3638 bp, Homo sapiens
tggttagactgtgaactatcgtaatagtaatgcctctgtgaacccggagtaatttagcgctgctgaagtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagtctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaa

SEQ ID NO: 316848 - DNA, 567 bp, Homo sapiens
  misc_feature (10)..(12): n is a, c, g, or t
tttttttttnnntttatgtcccccccccatccccccggcaattatacctaaatatggtgttttttttttttttttgagaaaggggaatttcatcccaaataaaaggaatgaagtctggctccggaggagggtccccgacctcgctgtgggggctcctgtttctctccgccgcgctctcgctctggccgacgagtggagaaagtgagtatgtgcccgccgcccgcggccactgcgggaacttttcctccgaggggctgcgccctgtttgcgaaacccgagttgccaccgtcgcagctgtcgggcccccgggctcgggagcggcggggtggggcgcagggcggctctgccgggagggaggctgcagcggacccgggacccgggctcgttcgtctggagccccgcggccctggccttggttttgttgtggtcggcgtcgtcgtcgccctctcttctgccgccccgcacttcctttgtacgtagttaataagcagtgtcgctccacattcgctgtcttttgcaatctgatagcttttgttttggtggtgtcgggtgggggttagtagggaa

SEQ ID NO: 316849 - DNA, 422 bp, Homo sapiens
accaccacgtcgaagaatcgcatcatcataacctggcaccggtaccggccccctgactacagggatctcatcagcttcaccgtttactacaaggaagcgtgagtttctgctttgggtgatgccattctgttgacagggctacgaatgggagaggccagtctttcgatccttgaatgggctggctgaatacagggggtcagcagagtccccagggagagccacgccaaacatccctacttcatcctcatgcaccctctcgggctgtccctgtgatgtcagtcacagccagtgacagccatgattgggaaagtgttagctcgaggcctgtcattctttagtgagtgattagaggtgtttgaataaaataaacccaaaatggggaaagcttgctttttccagaattaggtcagtccagactcatg

SEQ ID NO: 316850 - DNA, 6633 bp, Homo sapiens
  misc_feature (10)..(12): n is a, c, g, or t
tttttttttnnntttatgtcccccccccatccccccggcaattatacctaaatatggtgttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagtctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaa

SEQ ID NO: 316851 - DNA, 6491 bp, Homo sapiens
  misc_feature (10)..(12): n is a, c, g, or t
tttttttttnnntttatgtcccccccccatccccccggcaattatacctaaatatggtgttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagtctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaa

SEQ ID NO: 316852 - DNA, 4137 bp, Homo sapiens
ccgtgtggatgggggggttattctcaggtcagcccagtgttggcctccctccctgggaacccaaatccaactttgtcacctgtttaaattgtacagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagtctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaa

SEQ ID NO: 316853 - DNA, 3298 bp, Homo sapiens
tcggacccccagttaacaagcgtcaggggatgccacgctgggctgcttcacgccagctcaaggggcccctgtccgtgcctctcgggcttctccaccactggcttctctctctgactctttctcccttggtctctgtctgtctgtctctgtctccgtctgtgtgtctctgtcttcctctttctctctctctgtttctgtctcctgtctctgtttctttctatctccctctgtctctgtctatatctctatgtctcctgtttctgtctctatctgcctctatctctgtctctccaagcctccctgtctctgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagtctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaa

SEQ ID NO: 316854 - DNA, 2784 bp, Homo sapiens
  misc_feature (2652)..(2652): n is a, c, g, or t
aggcccggatggggccgagacccccgctgtccctgtacataaagagaccgatgggtgggagggggtcggctgctccccgagatccccctggcagagtcattcttccagccccaaccctgagttcctaaagggacacctccctcctgtccagcccttcaacagatcttctgttagatgacaaccgtgccgtgggccccgcgttgggccttgtctgaagggagaggccctggcatgcggatgggagatttagaggctgtggagaagggaacttggggctttccttccttcgtggcctcactcccctggggcctctctctatggagggggcaatggtttggtgaccagcaggctggattccaactagctaatgcattcagcaggtctgaggctggggccaggtgtcagccctaggcctccatccaacaccgtggaaatgttgctgccctcttcttggcgctgaccccaagattggggtttcctttctgccgctccctccactgttgtttatctaactgggcccccactccaggtccagagggactgtgctcactgcacagacatcactcagcttccgctccccagtcctgcagagctgttgccagggtgcagtggggaggggagtgaaatgtggaggactgtgtacctcagtcctctctctaaactcctcagcctcccaacaggggcctcctcacctgggttctgagtgtgtaccccttttagagagtgagatgccacccgggcagcactcgttaaagctggccagcacgagtgactaaggggagagagcatgacatagacctgggtggcaacggggacctctggaagcaggtgggagtaacagaggagagggcagtggagggtagaggaaaaggacctccagaggtggggtgtctgtgggggcggcctttgcctccctaaacctgtgcggaggagtggagtgtgcttgtcgctcaaacacatctctgggggactgaggacgttgtcacaagccccaactggagaaataattccaatggcagggtcagaggcaagcattctctaaatcttgcccaacccttccatccttccctatcctatgagctgaagccctgctgtgtgtcgcagggtcttcaaaggggcatcctgccaccaccccagggcgctggccccacgtcctgttcccctaaagctctgacaccgccttctctccgtgtgctccccccaccacctccaccctgatgtgcttcagtgtgcatgtctgtgaacagccctcctgccctgccaactcccctggctaaagtctccccagcagatttagcacccagggattgagctcacatttcaggctagagaggataacccttgggccacccacatctctcacccctgatgcttcttacttcgcctgagccatcagaactcctccttaccctccttcagcccctctcatcttccttcagcccagccaggcctgcaccaccaactgtgtggcctccacctatgcaacatcgcctctggctccccttcccttcttcctagcggggagtgtgaggggcccaaattgtggggataccatggcccatggcttctaaagggtttagctttactttcaggtagagatggctgagtgaggagggagaagaggctagagagagggaggcttgggcgggggaaacagctgcccaccaggttttcctggacagcagtgcccacctgcctactagcactgaacctgcctggaccctgagtctgtgctccttgggggcctggcgtttggagcacccttctttccctctgaatggacatctgtgaggtacaggtggtgagctgcagcctcaggctccatttcttagccagctggcacctggatgtcatgctttgtgtggggacagcctggccacctcagggctccaaggaaggaggaacgtggctcctcctccctcaggcctgttcctgagacagagcctggtctcacaagaggggaagggggacctctattattatttttgcctgtattgaccatttctgcctaggtcgtctcagacagcctcatctcccacacatgcacagacttagagagaaaccaattctttggtctattttcttggtagctttactgattgccagggaaaatgaaaaccagaaaattaattaatctctaaaattaaactttacactgaatgttcttgtttctctaattagaacttctgctagcagctgtggctatacacacacacacacacacacacacacaccctcacacctacacgtttgcactccggaactgtcagagggtgtcaggcacagacagactctaggttgcctagacaggcacacacatgcagtcactcccaagccccctttggtgctctgctcagcgcctgcttagcggaaggagtccctggagagcaggcactcctggactggggttgtagcccatgacctgccctttggggacacagttctggaggctctgggccaatgaatcagcccaaggaggatgggcaatggcgctcagcctgaatcagtcagctaggtctcttgtggccctgggggctgatgtgattcctgtaggtgtggccccagggtggacagctacagagtgatgggggactcatgtagggcacctggaaggctccatgtgtcctggggacaagggcttgtggggtgggntgggcctggctggggagaagacaggtctctgtcaattgggtgcatcacactgtggcctttttgtcgtggatttaagcgcaaagattgtacaaatcaaactggtggataataaagtcgtggatgactcactga

SEQ ID NO: 316855 - DNA, 1533 bp, Homo sapiens
  misc_feature (1472)..(1472): n is a, c, g, or t
  misc_feature (1477)..(1477): n is a, c, g, or t
aggcccggatggggccgagacccccgctgtccctgtacataaagagaccgatgggtgggagggggtcggctgctccccgagatccccctggcagagtcattcttccagccccaaccctgagttcctaaagggacacctccctcctgtccagcccttcaacagatcttctgttagatgacaaccgtgccgtgggccccgcgttgggccttgtctgaagggagaggccctggcatgcggatgggagatttagaggctgtggagaagggaacttggggctttccttccttcgtggcctcactcccctggggcctctctctatggagggggcaatggtttggtgaccagcaggctggattccaactagctaatgcattcagcaggtctgaggctggggccaggtgtcagccctaggcctccatccaacaccgtggaaatgttgctgccctcttcttggcgctgaccccaagattggggtttcctttctgccgctccctccactgttgtttatctaactgggcccccactccaggtccagagggactgtgctcactgcacagacatcactcagcttccgctccccagtcctgcagagctgttgccagggtgcagtggggaggggagtgaaatgtggaggactgtgtacctcagtcctctctctaaactcctcagcctcccaacaggggcctcctcacctgggttctgagtgtgtaccccttttagagagtgagatgccacccgggcagcactcgttaaagctggccagcacgagtgactaaggggagagagcatgacatagacctgggtggcaacggggacctctggaagcaggtgggagtaacagaggagagggcagtggagggtagaggaaaaggacctccagaggtggggtgtctgtgggggcggcctttgcctccctaaacctgtgcggaggagtggagtgtgcttgtcgctcaaacacatctctgggggactgaggacgttgtcacaagccccaactggagaaataattccaatggcagggtcagaggcaagcattctctaaatcttgcccaacccttccatccttccctatcctatgagctgaagccctgctgtgtgtcgcagggtcttcaaaggggcatcctgccaccaccccagggcgctggccccacgtcctgttcccctaaagctctgacaccgccttctctccgtgtgctccccccaccacctccaccctgatgtgcttcagtgtgcatgtctgtgaacagccctcctgccctgccaactcccctggctaaagtctccccagcagatttagcacccagggattgagctcacatttcaggctagagaggataacccttgggccacccacatctctcacccctgatgcttcttacttcgcctgagccatcagaactcctccttaccctccttcagcccctctcatcttccttcagcccagccaggcctgcactcgtgccgaattcggnacgantggccatggaggaggaggaggagaagaacgtggccgagctgaccgtcatggacgtg

SEQ ID NO: 316856 - DNA, 2159 bp, Homo sapiens
aggcccggatggggccgagacccccgctgtccctgtacataaagagaccgatgggtgggagggggtcggctgctccccgagatccccctggcagagtcattcttccagccccaaccctgagttcctaaagggacacctccctcctgtccagcccttcaacagatcttctgttagatgacaaccgtgccgtgggccccgcgttgggccttgtctgaagggagaggccctggcatgcggatgggagatttagaggctgtggagaagggaacttggggctttccttccttcgtggcctcactcccctggggcctctctctatggagggggcaatggtttggtgaccagcaggctggattccaactagctaatgcattcagcaggtctgaggctggggccaggtgtcagccctaggcctccatccaacaccgtggaaatgttgctgccctcttcttggcgctgaccccaagattggggtttcctttctgccgctccctccactgttgtttatctaactgggcccccactccaggtccagagggactgtgctcactgcacagacatcactcagcttccgctccccagtcctgcagagctgttgccagggtgcagtggggaggggagtgaaatgtggaggactgtgtacctcagtcctctctctaaactcctcagcctcccaacaggggcctcctcacctgggttctgagtgtgtaccccttttagagagtgagatgccacccgggcagcactcgttaaagctggccagcacgagtgactaaggggagagagcatgacatagacctgggtggcaacggggacctctggaagcaggtgggagtaacagaggagagggcagtggagggtagaggaaaaggacctccagaggtggggtgtctgtgggggcggcctttgcctccctaaacctgtgcggaggagtggagtgtgcttgtcgctcaaacacatctctgggggactgaggacgttgtcacaagccccaactggagaaataattccaatggcagggtcagaggcaagcattctctaaatcttgcccaacccttccatccttccctatcctatgagctgaagccctgctgtgtgtcgcagggtcttcaaaggggcatcctgccaccaccccagggcgctggccccacgtcctgttcccctaaagctctgacaccgccttctctccgtgtgctccccccaccacctccaccctgatgtgcttcagtgtgcatgtctgtgaacagccctcctgccctgccaactcccctggctaaagtctccccagcagatttagcacccagggattgagctcacatttcaggctagagaggataacccttgggccacccacatctctcacccctgatgcttcttacttcgcctgagccatcagaactcctccttaccctccttcagcccctctcatcttccttcagcccagccaggcctgcaccaccaactgtgtggcctccacctatgcaacatcgcctctggctccccttcccttcttcctagcggggagtgtgaggggcccaaattgtggggataccatggcccatggcttctaaagggtttagctttactttcaggtagagatggctgagtgaggagggagaagaggctagagagagggaggcttgggcgggggaaacagctgcccaccaggttttcctggacagcagtgcccacctgcctactagcactgaacctgcctggaccctgagtctgtgctccttgggggcctggcgtttggagcacccttctttccctctgaatggacatctgtgaggtacaggtggtgagctgcagcctcaggctccatttcttagccagctggcacctggatgtcatgctttgtgtggggacagcctggccacctcagggctccaaggaaggaggaacgtggctcctcctccctcaggcctgttcctgagacagagcctggtctcacaagaggggaagggggacctctattattatttttgcctgtattgaccatttctgcctaggtcgtctcagacagcctcatctcccacacatgcacagacttagagagaaaccaattctttggtctattttcttggtagctttactgattgccagggaaaatgaaaaccagaaaattaattaatctctaaaattaaactttacactga

SEQ ID NO: 316857 - DNA, 994 bp, Homo sapiens
gggctccaagcagctgcgactagcggaaagcgcgcgccagctgcacgcagggaaacagttctcattttgtgtgctcggctgactgcacgtccagcctcgggccagctcgagacggccacattgcctggttgaagatggctgagcgtaaaacagaatgcaagtcagctggagcacgtactactggaggcagagccccatgagaaggggccaagaacccgcacccatcaaaatcaagaagaaaggctgaacccggagagaaaagggagcaactgatgttgccatgcagatcccttggttgctatgagatggtaacatcactctgccccaccattggccagtgcctcctcagctgcggtgcctcccaggctgtgtggttctcacgcgggccactgacacagagctgttactatggtgaactttacaatttcctttgattggtggatttcagaaataggccatcagcggaattcattatattcagctaaatgctcttccagaaagaaaagccaggagtactcctggctggaggcggcatgcctgaggtcagagtcaaagtagggtttgtgctgtctgaatcctttctcccactctccccagcctggctcagcttctcagcttctcaggtggattggcctctgagcccaagccaagccatcgcatcccctgtgacttgcccgtatatatgcccagatggcctgaagtaactgaagaatcacaaaagaagtgaatatgccttgccccaccttgactgatgacattccaccacaaaagaagtgtaaatggccggtccttgccttaactgatgacattaccttgtgaaagtccttttcctggctcatcctggctcaaaaagcacccccactgagcatcttgcgactcccactcctgcccactgagcaccttgtgacccccactcctgcctgccagagaacaaaccccctttgactgtaattttcctttacctacccaaatcctataaaacggctccaccctt

SEQ ID NO: 316858 - DNA, 1495 bp, Homo sapiens
gggctccaagcagctgcgactagcggaaagcgcgcgccagctgcacgcagggaaacagttctcattttgtgtgctcggctgactgcacgtccagcctcgggccagctcgagacggccacattgcctggttgaagatggctgagcgtaaaacagaatgcaagtcagctggagcacgtactactggaggcagagccccatgagaaggggccaagaacccgcacccatcaaaatcaagaagaaaggctgaacccggagagaaaagggagcaactgatgttgccatgcagatcccttggttgctatgagatggtaacatcactctgccccaccattggccagtgcctcctcagctgcggtgcctcccaggctgtgtggttctcacgcgggccactgacacagagctgttactatggtgaactttacaatttcctttgattggtggatttcagaaataggccatcagcggaattcattatattcagctaagtaaaaatgaaaaataaatactataactttcccctcatcactaacatgaaggaaacgtgacccttcatgacataataaatcgctgttcggtaacttaggatccttcaggggactgaagcgggatgatcctcctatgccaaatttgggtgggaaagatattccctgtagctttgagtcgactcttcagagttaagggcagtgggccaaccagagttggaacttcagagttgggaggaggtgtgggatggggcatgcattgaacatgtaaactctattgtctctgaagtgatgggtgatgctgggggcctgagtgtggagggcagttttacatctcaggacaatgttttctcagatgctcttccagaaagaaaagccaggagtactcctggctggaggcggcatgcctgaggtcagagtcaaagtagggtttgtgctgtctgaatcctttctcccactctccccagcctggctcagcttctcagcttctcaggtggattggtgagtcctggccaattacgcttcagctcatctctactctcagcaaataggaaaagggagtgaaggactgagttttaactcttctaatttcgtaacctgactctctataagaaaaagtaggagaaagactgaagaacccgagagaacaggcctctgagcccaagccaagccatcgcatcccctgtgacttgcccgtatatatgcccagatggcctgaagtaactgaagaatcacaaaagaagtgaatatgccttgccccaccttgactgatgacattccaccacaaaagaagtgtaaatggccggtccttgccttaactgatgacattaccttgtgaaagtccttttcctggctcatcctggctcaaaaagcacccccactgagcatcttgcgactcccactcctgcccactgagcaccttgtgacccccactcctgcctgccagagaacaaaccccctttgactgtaattttcctttacctacccaaatcctataaaacggctccaccctt

SEQ ID NO: 316859 - DNA, 1824 bp, Homo sapiens
tcggagcatttttcactaagtctttagaggttttaagattcaaacactatgtaagaagaattatggtttgaactacgtaacaattacctagacatcttttggacttcagttaacctgtgtcaagcactgcagtagattctgaagatacaaaaataaataaaacattcctgccctcaagacacttacactcttatgtgtaacactgtgtgaccattcatctgggccttcctgagacagtcttggtttacacctgttttcccaatcagagcatcactgcctttcccactattctcctgcagaagagcaggggaaggaagcaccagggtccatcatggaggaagggtgttgccctgaacagctgacacaccctcagcaatgaagcttagttttgctggaacttttcagttgtgacaactgagattcagagatgtccaatctactcacataaatagcctggttgaagatggctgagcgtaaaacagaatgcaagtcagctggagcacgtactactggaggcagagccccatgagaaggggccaagaacccgcacccatcaaaatcaagaagaaaggctgaacccggagagaaaagggagcaactgatgttgccatgcagatcccttggttgctatgagatggtaacatcactctgccccaccattggccagtgcctcctcagctgcggtgcctcccaggctgtgtggttctcacgcgggccactgacacagagctgttactatggtgaactttacaatttcctttgattggtggatttcagaaataggccatcagcggaattcattatattcagctaagtaaaaatgaaaaataaatactataactttcccctcatcactaacatgaaggaaacgtgacccttcatgacataataaatcgctgttcggtaacttaggatccttcaggggactgaagcgggatgatcctcctatgccaaatttgggtgggaaagatattccctgtagctttgagtcgactcttcagagttaagggcagtgggccaaccagagttggaacttcagagttgggaggaggtgtgggatggggcatgcattgaacatgtaaactctattgtctctgaagtgatgggtgatgctgggggcctgagtgtggagggcagttttacatctcaggacaatgttttctcagatgctcttccagaaagaaaagccaggagtactcctggctggaggcggcatgcctgaggtcagagtcaaagtagggtttgtgctgtctgaatcctttctcccactctccccagcctggctcagcttctcagcttctcaggtggattggtgagtcctggccaattacgcttcagctcatctctactctcagcaaataggaaaagggagtgaaggactgagttttaactcttctaatttcgtaacctgactctctataagaaaaagtaggagaaagactgaagaacccgagagaacaggcctctgagcccaagccaagccatcgcatcccctgtgacttgcccgtatatatgcccagatggcctgaagtaactgaagaatcacaaaagaagtgaatatgccttgccccaccttgactgatgacattccaccacaaaagaagtgtaaatggccggtccttgccttaactgatgacattaccttgtgaaagtccttttcctggctcatcctggctcaaaaagcacccccactgagcatcttgcgactcccactcctgcccactgagcaccttgtgacccccactcctgcctgccagagaacaaaccccctttgactgtaattttcctttacctacccaaatcctataaaacggctccaccctt

SEQ ID NO: 316860 - DNA, 1756 bp, Homo sapiens
tcggagcatttttcactaagtctttagaggttttaagattcaaacactatgtaagaagaattatggtttgaactacgtaacaattacctagacatcttttggacttcagttaacctgtgtcaagcactgcagtagattctgaagatacaaaaataaataaaacattcctgccctcaagacacttacactcttatgtgtaacactgtgtgaccattcatctgggccttcctgagacagtcttggtttacacctgttttcccaatcagagcatcactgcctttcccactattctcctgcagaagagcaggggaaggaagcaccagggtccatcatggagttgtgacaactgagattcagagatgtccaatctactcacataaatagcctggttgaagatggctgagcgtaaaacagaatgcaagtcagctggagcacgtactactggaggcagagccccatgagaaggggccaagaacccgcacccatcaaaatcaagaagaaaggctgaacccggagagaaaagggagcaactgatgttgccatgcagatcccttggttgctatgagatggtaacatcactctgccccaccattggccagtgcctcctcagctgcggtgcctcccaggctgtgtggttctcacgcgggccactgacacagagctgttactatggtgaactttacaatttcctttgattggtggatttcagaaataggccatcagcggaattcattatattcagctaagtaaaaatgaaaaataaatactataactttcccctcatcactaacatgaaggaaacgtgacccttcatgacataataaatcgctgttcggtaacttaggatccttcaggggactgaagcgggatgatcctcctatgccaaatttgggtgggaaagatattccctgtagctttgagtcgactcttcagagttaagggcagtgggccaaccagagttggaacttcagagttgggaggaggtgtgggatggggcatgcattgaacatgtaaactctattgtctctgaagtgatgggtgatgctgggggcctgagtgtggagggcagttttacatctcaggacaatgttttctcagatgctcttccagaaagaaaagccaggagtactcctggctggaggcggcatgcctgaggtcagagtcaaagtagggtttgtgctgtctgaatcctttctcccactctccccagcctggctcagcttctcagcttctcaggtggattggtgagtcctggccaattacgcttcagctcatctctactctcagcaaataggaaaagggagtgaaggactgagttttaactcttctaatttcgtaacctgactctctataagaaaaagtaggagaaagactgaagaacccgagagaacaggcctctgagcccaagccaagccatcgcatcccctgtgacttgcccgtatatatgcccagatggcctgaagtaactgaagaatcacaaaagaagtgaatatgccttgccccaccttgactgatgacattccaccacaaaagaagtgtaaatggccggtccttgccttaactgatgacattaccttgtgaaagtccttttcctggctcatcctggctcaaaaagcacccccactgagcatcttgcgactcccactcctgcccactgagcaccttgtgacccccactcctgcctgccagagaacaaaccccctttgactgtaattttcctttacctacccaaatcctataaaacggctccaccctt

SEQ ID NO: 316861 - DNA, 1952 bp, Homo sapiens
tcggagcatttttcactaagtctttagaggttttaagattcaaacactatgtaagaagaattatggtttgaactacgtaacaattacctagacatcttttggacttcagttaacctgtgtcaagcactgcagtagattctgaagatacaaaaataaataaaacattcctgccctcaagacacttacactcttatgtgtaacactgtgtgaccattcatctgggccttcctgagacagtcttggtttacacctgttttcccaatcagagcatcactgcctttcccactattctcctgcagaagagcaggggaaggaagcaccagggtccatcatggaggaagggtgttgccctgaacagctgacacaccctcagcaatgaagcttagttttgctggaacttttcagttgtgacaactgagattcagagatgtccaatctactcacataaatatttctagcccatgacagactgacgtatctaaaaatcatagattaggtaaagaatgtgtgcaaattaaaatccatgcacagaaacctatgtgagaagaaggagcgttgtcatcgcagacgtttaactgggcctggttgaagatggctgagcgtaaaacagaatgcaagtcagctggagcacgtactactggaggcagagccccatgagaaggggccaagaacccgcacccatcaaaatcaagaagaaaggctgaacccggagagaaaagggagcaactgatgttgccatgcagatcccttggttgctatgagatggtaacatcactctgccccaccattggccagtgcctcctcagctgcggtgcctcccaggctgtgtggttctcacgcgggccactgacacagagctgttactatggtgaactttacaatttcctttgattggtggatttcagaaataggccatcagcggaattcattatattcagctaagtaaaaatgaaaaataaatactataactttcccctcatcactaacatgaaggaaacgtgacccttcatgacataataaatcgctgttcggtaacttaggatccttcaggggactgaagcgggatgatcctcctatgccaaatttgggtgggaaagatattccctgtagctttgagtcgactcttcagagttaagggcagtgggccaaccagagttggaacttcagagttgggaggaggtgtgggatggggcatgcattgaacatgtaaactctattgtctctgaagtgatgggtgatgctgggggcctgagtgtggagggcagttttacatctcaggacaatgttttctcagatgctcttccagaaagaaaagccaggagtactcctggctggaggcggcatgcctgaggtcagagtcaaagtagggtttgtgctgtctgaatcctttctcccactctccccagcctggctcagcttctcagcttctcaggtggattggtgagtcctggccaattacgcttcagctcatctctactctcagcaaataggaaaagggagtgaaggactgagttttaactcttctaatttcgtaacctgactctctataagaaaaagtaggagaaagactgaagaacccgagagaacaggcctctgagcccaagccaagccatcgcatcccctgtgacttgcccgtatatatgcccagatggcctgaagtaactgaagaatcacaaaagaagtgaatatgccttgccccaccttgactgatgacattccaccacaaaagaagtgtaaatggccggtccttgccttaactgatgacattaccttgtgaaagtccttttcctggctcatcctggctcaaaaagcacccccactgagcatcttgcgactcccactcctgcccactgagcaccttgtgacccccactcctgcctgccagagaacaaaccccctttgactgtaattttcctttacctacccaaatcctataaaacggctccaccctt

SEQ ID NO: 316862 - DNA, 1031 bp, Homo sapiens
gggctccaagcagctgcgactagcggaaagcgcgcgccagctgcacgcagggaaacagttctcattttgtgtgctcggctgactgcacgtccagcctcgggccagctcgagacggccacattgcctggttgaagatggctgagcgtaaaacagaatgcaagtcagctggagcacgtactactggaggcagagccccatgagaaggggccaagaacccgcacccatcaaaatcaagaagaaaggctgaacccggagagaaaagggagcaactgatgttgccatgcagatcccttggttgctatgagatggtaacatcactctgccccaccattggccagtgcctcctcagctgcggtgcctcccaggctgtgtggttctcacgcgggccactgacacagagctgttactatggtgaactttacaatttcctttgattggtggatttcagaaataggccatcagcggaattcattatattcagctaacctggctcagcttctcagcttctcaggtggattggtgagtcctggccaattacgcttcagctcatctctactctcagcaaataggaaaagggagtgaaggactgagttttaactcttctaatttcgtaacctgactctctataagaaaaagtaggagaaagactgaagaacccgagagaacaggcctctgagcccaagccaagccatcgcatcccctgtgacttgcccgtatatatgcccagatggcctgaagtaactgaagaatcacaaaagaagtgaatatgccttgccccaccttgactgatgacattccaccacaaaagaagtgtaaatggccggtccttgccttaactgatgacattaccttgtgaaagtccttttcctggctcatcctggctcaaaaagcacccccactgagcatcttgcgactcccactcctgcccactgagcaccttgtgacccccactcctgcctgccagagaacaaaccccctttgactgtaattttcctttacctacccaaatcctataaaacggctccaccctt

SEQ ID NO: 316863 - DNA, 165 bp, Homo sapiens
cctcatccaatgagttgaaggcctgcagagatcaaaaggctgaccacccctagaagacaagaaggaattctgccagtcgacagcatttggacgtgaactgcaacattaggtcttccttgggtctccagcctgccagcccaccctacagattttggacttgccaga

SEQ ID NO: 316864 - DNA, 4717 bp, Homo sapiens
gcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaacaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagtttggtagtcaatggcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatccaacta

SEQ ID NO: 316865 - DNA, 512 bp, Homo sapiens
  misc_feature (18)..(18): n is a, c, g, or t
  misc_feature (50)..(50): n is a, c, g, or t
agagagagagagagaganagagagagagagagagagagaggagagagagngagagagagagagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatccaacta

SEQ ID NO: 316866 - DNA, 261 bp, Homo sapiens
aaaccaggaatggatctggcagacacctatattatgtttgttcggcaaaaccaagatattcttcgagaaaaggtcaatgaggaaatgtatatagaaaagttatttgatgtaagtagcttcccttgcaaggtatgctgacaccatagataaactgcaaagagaaaagttgaattttgatggtatgtttgcaaagcatagtctcctttttgtgatcctgtatcttctatactaaaaagttgaagctggccaggcatagtggct

SEQ ID NO: 316867 - DNA, 417 bp, Homo sapiens
acgcatataatctaagtgagctaagcaaattttatcttctttcttcagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttg

SEQ ID NO: 316868 - DNA, 3997 bp, Homo sapiens
gcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaacaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagtttggtagtcaatggcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttcttt

SEQ ID NO: 316869 - DNA, 2498 bp, Homo sapiens
gacgagccgagccgagccaagcggagctgggccactgtgcacgcccggagggtcctggcggcgcccccgctcctgcgcgcactctcggcgccggacacgagcactgcctgccgggaacaggctgggggaggtgcgggggcttggcccacttggtggaagaacagctttggggattttttttttttcattgtcggatacaggcatttcaaagggaaaccgttgaaatgcataacctgcaaacactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaa

SEQ ID NO: 316870 - DNA, 6600 bp, Homo sapiens
cattcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctattctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgccagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtatatatatatatatatatatatatatatatatgtgtgtgtgtatatatatatatatgtgtatatatatatgtatatacatatatgtatatatacgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgaga

SEQ ID NO: 316871 - DNA, 6348 bp, Homo sapiens
cattcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctattctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgccagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 316872 - DNA, 5639 bp, Homo sapiens
cattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctattctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgccagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtatatatatatatatatatatatatatatatatgtgtgtgtgtatatatatatatatgtgtatatatatatgtatatacatatatgtatatatacgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 316873 - DNA, 6046 bp, Homo sapiens
agcagctggagcggagttggaggaagcagcggcagcggcgagggcggcaggctagctgtcggagacggcaagcacggatcgggcacggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctattctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgccagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtatatatatatatatatatatatatatatatatgtgtgtgtgtatatatatatatatgtgtatatatatatgtatatacatatatgtatatatacgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 316874 - DNA, 6728 bp, Homo sapiens
cattcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaacagtttttcttctctcctctctagggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctattctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgccagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtatatatatatatatatatatatatatatatatgtgtgtgtgtatatatatatatatgtgtatatatatatgtatatacatatatgtatatatacgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 316875 - DNA, 4860 bp, Homo sapiens
acatgcagagatggagagttgtgcagacacctcaaggacagccagaaagaaggaatcctatgaatagtcataatgggagtaatagtaacactgctagtcatggagcactgcagatagttgtcctcatcatgattggaagctaccacttgttgcatgcttactgcatgtcaggcattctatctagcattttgcatgcatgatctcatttcatttctcaaagtaactgtattacatgcattttactattgtcttccctttaaaccattttaaagatgaaaatacagtcagtcagtgaagctgggttacctacccaaggcactcggccaggtgtcagttgtaacctaggaccctttccccaagttgagactgcacaataatgctttttattaaagatgccctgaagagttgtgaattgtcttggacaagctcaaaagacagtttttcttctctcctctctagggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctattctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgccagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtatatatatatatatatatatatatatatatatgtgtgtgtgtatatatatatatatgtgtatatatatatgtatatacatatatgtatatatacgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 316876 - DNA, 4770 bp, Homo sapiens
cattcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataataaaaaaaaaaatatataaaaaaaaaaattttatttattctttttatttatattttctttttttaataaatttattttttaatgttcctataattttataccttttttaaatattctctttaaaaggctcttttaaataaaacttgtcacattttttaccaaccttctaggggaaaaactcgggtgtccccaaatatagtgcttatgatacaaattcccctttttgctctttgcgtatatatctaaaggtcctccacctatcttgtttttccacaacgtcatctcttcatttttctagaaatatttctgcgccttattttttctggttctccttaactttcttttaataacgtcctttttttttaaccattgcgaccatacttctaaatctctcttttatatctaatacaaccctcttcttaatcttttttcttcttctctcttttcctttccg

SEQ ID NO: 316877 - DNA, 4157 bp, Homo sapiens
cattcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataataaaaaaaaaaatatataaaaaaaaaaattttatttattctttttatttatattttctttttttaataaatttattttttaatgttcctataattttataccttttttaaatattctctttaaaaggctcttttaaataaaacttgtcacattttttaccaaccttctaggggaaaaactcgggtgtccccaaatatagtgcttatgatacaaattcccctttttgctctttgcgtatatatctaaaggtcctccacctatcttgtttttccacaacgtcatctcttcatttttctagaaatatttctgcgccttattttttctggttctccttaactttcttttaataacgtcctttttttttaaccattgcgaccatacttctaaatctctcttttatatctaatacaaccctcttcttaatcttttttcttcttctctcttttcctttccg

SEQ ID NO: 316878 - DNA, 1653 bp, Homo sapiens
ccgttcagacaatattgttaggactgtctgatgaaatccaaagtggccggctagcaaagtaggattcatcattccatatgacttgagttacaccagacctattctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgccagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtatatatatatatatatatatatatatatatatgtgtgtgtgtatatatatatatatgtgtatatatatatgtatatacatatatgtatatatacgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 316879 - DNA, 369 bp, Homo sapiens
ctcccacaccaaagccccggccacctcggcctcttcctgttgcaccaggttcttcgaaaactgaagcagatgttgaacaacaaggtcagtattgataagtggttgcttaatgactccctttctttttctttttaaggaaaagtcttaagtttgggttgagtcgttatgttctgggcagaagttaccttggcaactgcacctgaattgatgtgtggtgcataaaagcttggtcaatcattacacaactagaaatttgtgtttgtggggttggaagttgttataaaaatagggacacagtatccgagaacctgtttagtgagtgtcgttgaacactattattatagttgtcattgaattaaacatctacta

SEQ ID NO: 316880 - DNA, 635 bp, Homo sapiens
gtaagatttttaaaccaaggaatgactgggctatctataaacccagatgcactaagtggggagaaaagctcggagctgcagcatatcagcttttgtcaacctgccaacagcagagcgtaccatgctgcaaggagtaataaacaaggaattagaaaactcgctgctggagaacagtcaaattaaacacctttttgaaaggatgagcatgtatatattgcagttctattaaatgtagcttcttagtgaggttggcattatgttaaggctggtatggaagagaactgatgaagcaggagtggtctggtgacatttttctgacttgattggctggggcgtgtgatgtaataggtttcagtgcagccccttataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccaggtaatactgcagtattattgtagagagttagttaatttcgtggctttttaatttttcgaaagctactgtaaa

SEQ ID NO: 316881 - DNA, 402 bp, Homo sapiens
atgaaaccataaaaatatttgaagaacagtgccagacccaagagcggtacagcaaagaatacatagaaaagtttaaacgtgaaggcaatgagaaagaaatacaaaggttggtgtttcccttgttcttgtgctagagataaccaaaatcctctaaaaccatttaaagatgatctcgctttctgtgctttgaatgatcacgtggacacaggaaggggaatatcactctggggactgtggtggggtggggggaggagggagggatagcattgggagatatacctaatgctagatgacgagttagtgggtgcggcgcaccagcatggcacatgtatacatatgtaactaacctgcacaatgtgcacatgtaccctaaaacttaaagtataataaaaataaaaaaat

SEQ ID NO: 316882 - DNA, 6784 bp, Homo sapiens
cattcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctattctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgccagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtatatatatatatatatatatatatatatatatgtgtgtgtgtatatatatatatatgtgtatatatatatgtatatacatatatgtatatatacgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 316883 - DNA, 6952 bp, Homo sapiens
cattcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctattctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgccagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtatatatatatatatatatatatatatatatatgtgtgtgtgtatatatatatatatgtgtatatatatatgtatatacatatatgtacgcgtgtgcgcatacatgtacgcatgtaacgtgtcatgtgcgcgtgatctttggggtgactcagatcgagagcgcgcgcgtacgcgttcgctcgcgcgtgcgctcgtcatatttcacgagcgcgcgagcgcgagagcgcgcgcgcgactcaactctagagctgtagagaaacattccacttttgcacacttgtgatatctttaggaggtcgcgtacagatatgattttcctaactatttctaccaacttgaatggttaatgtcatatacttacagttttctatctttctgcttagtctggtaaactctctcataacattatcatattatactacatcctatggtttataatagcataacatcttttatatcatctatataaataactcgttaatgatgagatatcccttcctatctcaacaatggttgtcatattatatcaactcgcatttactacagtacaggtgctcatatatctactcattacgttctatatctctactg

SEQ ID NO: 316884 - DNA, 6735 bp, Homo sapiens
cattcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggtaagccagggaatatagctgaaattaggttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctattctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgccagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtatatatatatatatatatatatatatatatatgtgtgtgtgtatatatatatatatgtgtatatatatatgtatatacatatatgtatatatacgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 316885 - DNA, 5710 bp, Homo sapiens
gacgagccgagccgagccaagcggagctgggccactgtgcacgcccggagggtcctggcggcgcccccgctcctgcgcgcactctcggcgccggacacgagcactgcctgccgggaacaggctgggggaggtgcgggggcttggcccacttggtggaagaacagctttggggattttttttttttcattgtcggatacaggcatttcaaagggaaaccgttgaaatgcataacctgcaaacactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctattctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgccagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtatatatatatatatatatatatatatatatatgtgtgtgtgtatatatatatatatgtgtatatatatatgtatatacatatatgtatatatacgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 316886 - DNA, 6743 bp, Homo sapiens
cattcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctattctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgccagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtatatatatatatatatatatatatatatatatgtgtgtgtgtatatatatatatatgtgtatatatatatgtatatacatatatgtatatatacgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 316887 - DNA, 2451 bp, Homo sapiens
  misc_feature (2397)..(2397): n is a, c, g, or t
cattcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaantaaagcattgtgtcataaacgaactggtgctacattacccaccccttccttggg

SEQ ID NO: 316888 - DNA, 2222 bp, Homo sapiens
cgcgcgcgggcgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagca

SEQ ID NO: 316889 - DNA, 1919 bp, Homo sapiens
ccagaacccctgcgccggagggagggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagca

SEQ ID NO: 316890 - DNA, 1689 bp, Homo sapiens
cgcgcgcgggcgcgcgggccgggcctgcccctccgaggcgccgtagcgcgggagggaggcggcggcgctgtggtccgtgggtccgccggtccgtgggttgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagca

SEQ ID NO: 316891 - DNA, 1958 bp, Homo sapiens
cgcgcgcgggcgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagca

SEQ ID NO: 316892 - DNA, 2102 bp, Homo sapiens
cgcgcgcgggcgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtgaccccagcaccctcaccccttactccccagaggcaacttcccaatatccccaactcttgaccccaagtggcccaatccctgatcccccagtgggggacctccaagcatccttgactccaaaaaggtgactcccagtgccactgattccctgatgtgatccaaggcccctcaggactgctggcacccctgatcgttgtcccccaacccccagcccagcctcagcccaatatctctgacctctggcctgattcctagaggtgaccagaatttaatgtcagggcctaaatagtcattgagtagattgcattcctattggtgccctcgaagacctcacttgtgcacctgtgggacccctgccggggcagataggacacgagctaatgggtgctgggcacagctcctgtggacctgacaaaggggacctgagcagtatgggaagggggtgtggaaagacagtgcccacccctctgaaattgaaggaggtggatgtatctcttaggaggtagccacatttggtatcaggctggctgggagaagggcctaaagggtgtgtgaaatgtaaacaagggcttcctgacactgctctgacttgtgctaaactttctgggggtgggagacccagagtagtcacacccaatccgtgctttcccttacgaagttcattccaggcagggagatagtcatggaaaaaggcagttatagcacaaggtcatcaaggcaaggtgttgtcttggcagaagagggactggtg

SEQ ID NO: 316893 - DNA, 1103 bp, Homo sapiens
cgcgcgcgggcgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagca

SEQ ID NO: 316894 - DNA, 2327 bp, Homo sapiens
cgcgcgcgggcgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggtgagaggagggcgcgcgcggcccccacccagggccccgagattccagacccagccccgcgaggggcaccccgagcgcggccccgagatcccaacccaggagccggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagca

SEQ ID NO: 316895 - DNA, 2173 bp, Homo sapiens
cgcgcgcgggcgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttggcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcagaacccactttggggggcctcctgcctgggcaggctcttcaagtgtggccctctttggagtcaaccctccttcccgaccccctccccctagcccagccccagtcactgtcagggtcgggccagcccctgcactgcctcgcagagtggcctgggctaggtcactccacctctctgtgcctcagtttcccccccttgagtcccctagggcctggaagggtgggaggtatgtctagggggcagtgtctcttccagggggaattctcagctcttgggaacccccttgctcccaggggaggggaaacctttttcattcaacattgtagggggcaagctttggtgcgccccctgctgaggagcagccccaggaggggaccagaggggatgctgtgtcgctgcctgggatcttggggttggcctttgcatgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagca

SEQ ID NO: 316896 - DNA, 1800 bp, Homo sapiens
cgcgcgcgggcgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttcactaggccccctagctacacctggaagtttcaggggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagca

SEQ ID NO: 316897 - DNA, 1350 bp, Homo sapiens
cgcgcgcgggcgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggtcctatgctggtacttgcaggtgggccagctgagaagccagttcgagatcaggtcccacgagactgggctggggggcaggagtagacactcacggacccggaaggagaacttcaggccgaactgaaggcgaccataaaacacggaataacacccgaggacagtaaaagagacaaagggtgtcgggcatttgtcgcccccacaaaggcgccccccaaaaggaacaacaac

SEQ ID NO: 316898 - DNA, 744 bp, Homo sapiens
cgcgcgcgggcgcgcgggccgggcctgcccctccgaggcgccgtagcgcgggagggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcgggaggcaggtggggcttggatcagtaagtctggttcccgcctccctgtctgagagaggaggcaggagccccagggccggcttgtgtttgtacattgcacagaaacttgtgtgggtgctttagtaaaaaacgtgaatggagca

SEQ ID NO: 316899 - DNA, 3448 bp, Homo sapiens
gcacggagattgttgccagggctctggtgagttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccag

SEQ ID NO: 316900 - DNA, 1065 bp, Homo sapiens
tctctgggtgtggggtttggacgcaccaggagaggtacttaataatgccttcacctggagcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316901 - DNA, 5975 bp, Homo sapiens
ttgagtggctctgcggcccgctcccatctaccattggcaggatgcctgtcagtcattccgtcccgcctcctcggacccgccccggccggcggcgcgatcccgagaaccagccggcccgcgcactcactggtcgtcatgcgctgtctgtcatgaagctggccacaccttccatggggtgcgggtcctgggagtcctggctggacctcattggcttgtggcgccttcactcggagagacgcgcctcaacccggaagtgtgcgaggcgaaatctgcctagcaaccggggaagccgggctgtgaagcgggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316902 - DNA, 5490 bp, Homo sapiens
acctctgcccacgcatccagtatgtgcagcacacctgctctgtgactgacactcttgcagaagtggggccacttcagggacatggacaaggtgttgtacctgctgtcacagagcctgttatctgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316903 - DNA, 5150 bp, Homo sapiens
gctgaatctagaggataaaacaacggtagtgtggcccatggcttgcccacggcagacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316904 - DNA, 4799 bp, Homo sapiens
gaatttctgtccttagggttcagtctaccaggatggacagacacaacaggggagcggcaggtgggggcaaggctgtaggtgggcttgggctggccccgtgaatgtctgaccaccgctgtcaccgccatagcagcagggcagcttctccggaacttgtataaatgaagcgtgtcctccttgccccagacctgctgccctggcttctgagagcctgttatcatggctgggttcacttttgttaaggacgccatcgtcaagggtactggttagtgcagttgacaggacctcgggcttcggggcgctggggagccttcctctgggcaggcgcacggagcgccctgactgagtttttgtctcccaaagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316905 - DNA, 6224 bp, Homo sapiens
  misc_feature (6168)..(6168): n is a, c, g, or t
ttgagtggctctgcggcccgctcccatctaccattggcaggatgcctgtcagtcattccgtcccgcctcctcggacccgccccggccggcggcgcgatcccgagaaccagccggcccgcgcactcactggtcgtcatgcgctgtctgtcatgaagctggccacaccttccatggggtgcgggtcctgggagtcctggctggacctcattggcttgtggcgccttcactcggagagacgcgcctcaacccggaagtgtgcgaggcgaaatctgcctagcaaccggggaagccgggctgtgaagcgggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactggaccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaaggnaccctccacgcgcgtgcacacagcttccctggtaataaagagctggcatctttctt

SEQ ID NO: 316906 - DNA, 5049 bp, Homo sapiens
ttgagtggctctgcggcccgctcccatctaccattggcaggatgcctgtcagtcattccgtcccgcctcctcggacccgccccggccggcggcgcgatcccgagaaccagccggcccgcgcactcactggtcgtcatgcgctgtctgtcatgaagctggccacaccttccatggggtgcgggtcctgggagtcctggctggacctcattggcttgtggcgccttcactcggagagacgcgcctcaacccggaagtgtgcgaggcgaaatctgcctagcaaccggggaagccgggctgtgaagcgggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaacaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316907 - DNA, 4212 bp, Homo sapiens
ttgagtggctctgcggcccgctcccatctaccattggcaggatgcctgtcagtcattccgtcccgcctcctcggacccgccccggccggcggcgcgatcccgagaaccagccggcccgcgcactcactggtcgtcatgcgctgtctgtcatgaagctggccacaccttccatggggtgcgggtcctgggagtcctggctggacctcattggcttgtggcgccttcactcggagagacgcgcctcaacccggaagtgtgcgaggcgaaatctgcctagcaaccggggaagccgggctgtgaagcgggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316908 - DNA, 4135 bp, Homo sapiens
  misc_feature (3903)..(3905): n is a, c, g, or t
  misc_feature (3924)..(3924): n is a, c, g, or t
  misc_feature (3930)..(3930): n is a, c, g, or t
  misc_feature (3935)..(3935): n is a, c, g, or t
  misc_feature (3947)..(3947): n is a, c, g, or t
  misc_feature (3958)..(3958): n is a, c, g, or t
  misc_feature (3963)..(3963): n is a, c, g, or t
  misc_feature (3966)..(3966): n is a, c, g, or t
  misc_feature (3968)..(3968): n is a, c, g, or t
  misc_feature (3975)..(3975): n is a, c, g, or t
  misc_feature (3992)..(3992): n is a, c, g, or t
  misc_feature (4016)..(4016): n is a, c, g, or t
  misc_feature (4020)..(4020): n is a, c, g, or t
  misc_feature (4022)..(4023): n is a, c, g, or t
  misc_feature (4035)..(4035): n is a, c, g, or t
  misc_feature (4041)..(4041): n is a, c, g, or t
  misc_feature (4046)..(4046): n is a, c, g, or t
  misc_feature (4064)..(4064): n is a, c, g, or t
  misc_feature (4068)..(4068): n is a, c, g, or t
  misc_feature (4070)..(4071): n is a, c, g, or t
  misc_feature (4079)..(4079): n is a, c, g, or t
  misc_feature (4086)..(4086): n is a, c, g, or t
  misc_feature (4090)..(4090): n is a, c, g, or t
  misc_feature (4103)..(4103): n is a, c, g, or t
  misc_feature (4108)..(4108): n is a, c, g, or t
  misc_feature (4110)..(4110): n is a, c, g, or t
  misc_feature (4122)..(4123): n is a, c, g, or t
  misc_feature (4132)..(4132): n is a, c, g, or t
ttgagtggctctgcggcccgctcccatctaccattggcaggatgcctgtcagtcattccgtcccgcctcctcggacccgccccggccggcggcgcgatcccgagaaccagccggcccgcgcactcactggtcgtcatgcgctgtctgtcatgaagctggccacaccttccatggggtgcgggtcctgggagtcctggctggacctcattggcttgtggcgccttcactcggagagacgcgcctcaacccggaagtgtgcgaggcgaaatctgcctagcaaccggggaagccgggctgtgaagcgggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctaacaagaatagtcaagttcatttcccagagtcttaagactaagttctgcctcctcattgcaggtgtgccgagagttttttttgaacaacaaaaattactaaggaacctcactacctttggcggtagaattagaaaacagattcagcagtcacctactccccttcagtaattcgagacaattatttttctcctgacacaacatcaggtcccatgaaaaatgacacttgctggcctggcgcggtggctcacnnntgtaatcccagcactttgngaggcngaggngggtggatcacnaggtcaggagntcganacnancctggcnaacatggtgaaaccccntctctactaaaaatacaaaaattngccngnngtggtggtgggngcctanagtcngggaggctgaggcagganaatngnntgaacccnggaggcngagnttgcagtgagccnagatngngccactgcactnnagcctgggnaag

SEQ ID NO: 316909 - DNA, 2134 bp, Homo sapiens
aggggacgggcctgtcctgtggggctcaccctcggtcaccctgggccggccagcggaccgcactgactttgctttcaacccccgtttgtgtaggtcataaaaccccggcgtaagttggcgttccgctcaggagaggcccgcgactggagtaacggggctgtgctacaggtcagaaccgcactgggcgccgggagcctcgcgcccccaccgcagcccgtgaccacgtcagtcgccgactgtcacgctgcctcttctgtctgtctctccctgtttctgtttcactctctccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316910 - DNA, 523 bp, Homo sapiens
ggggtttcaccacgttggccagggtggtttcaaacttctgacctcatgatctgcgtacttcggcctcacaaagtgctgggattacaggcatctgccactgtgcccatccataattttctttaacttctgtgctacttaaaaaaagcaagataaaaaaactagtatgtactttcataaaagcagcaaaactgcttgctttaaaaaaagtgtgggggggtccggtccatgtaaatctgggtcttggtatcgttggcagacctcttcagctcggatgcccggcagtgtcatacccccgcccctggtccgaggtgggcagcaggcgtcctcgaagctggggccacaggcgagctcacaggtcgtcatgcccccactcgtcaggggggctcaggtaagcagggctgtgcacatgggggagacctggcagcctcagcagtcgtctacggtgaaagtaggctctttcccagtccttgggggcaaggtgcaatgtgccttccggtcccggtccattgttgactgggttgat

SEQ ID NO: 316911 - DNA, 6064 bp, Homo sapiens
ttgagtggctctgcggcccgctcccatctaccattggcaggatgcctgtcagtcattccgtcccgcctcctcggacccgccccggccggcggcgcgatcccgagaaccagccggcccgcgcactcactggtcgtcatgcgctgtctgtcatgaagctggccacaccttccatggggtgcgggtcctgggagtcctggctggacctcattggcttgtggcgccttcactcggagagacgcgcctcaacccggaagtgtgcgaggcgaaatctgcctagcaaccggggaagccgggctgtgaagcgggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcggttggtcagcacattgtctcaagtagccttttgatgtcactgtggccatggccaactggtaggaccagcaccccataccccgaagccagttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316912 - DNA, 5397 bp, Homo sapiens
gcacggagattgttgccagggctctggtgagttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316913 - DNA, 5900 bp, Homo sapiens
ttgagtggctctgcggcccgctcccatctaccattggcaggatgcctgtcagtcattccgtcccgcctcctcggacccgccccggccggcggcgcgatcccgagaaccagccggcccgcgcactcactggtcgtcatgcgctgtctgtcatgaagctggccacaccttccatggggtgcgggtcctgggagtcctggctggacctcattggcttgtggcgccttcactcggagagacgcgcctcaacccggaagtgtgcgaggcgaaatctgcctagcaaccggggaagccgggctgtgaagcgggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316914 - DNA, 5921 bp, Homo sapiens
ttgagtggctctgcggcccgctcccatctaccattggcaggatgcctgtcagtcattccgtcccgcctcctcggacccgccccggccggcggcgcgatcccgagaaccagccggcccgcgcactcactggtcgtcatgcgctgtctgtcatgaagctggccacaccttccatggggtgcgggtcctgggagtcctggctggacctcattggcttgtggcgccttcactcggagagacgcgcctcaacccggaagtgtgcgaggcgaaatctgcctagcaaccggggaagccgggctgtgaagcgggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316915 - DNA, 3880 bp, Homo sapiens
ggaagaggtcagccagagcaaggagaggctgcgctgagtgtctcgcctgctgctgtcttttccctgcatgagccgtcacccccctttctccactgcaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316916 - DNA, 4098 bp, Homo sapiens
ttgagtggctctgcggcccgctcccatctaccattggcaggatgcctgtcagtcattccgtcccgcctcctcggacccgccccggccggcggcgcgatcccgagaaccagccggcccgcgcactcactggtcgtcatgcgctgtctgtcatgaagctggccacaccttccatggggtgcgggtcctgggagtcctggctggacctcattggcttgtggcgccttcactcggagagacgcgcctcaacccggaagtgtgcgaggcgaaatctgcctagcaaccggggaagccgggctgtgaagcgggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaacttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgga

SEQ ID NO: 316917 - DNA, 1204 bp, Homo sapiens
ttgagtggctctgcggcccgctcccatctaccattggcaggatgcctgtcagtcattccgtcccgcctcctcggacccgccccggccggcggcgcgatcccgagaaccagccggcccgcgcactcactggtcgtcatgcgctgtctgtcatgaagctggccacaccttccatggggtgcgggtcctgggagtcctggctggacctcattggcttgtggcgccttcactcggagagacgcgcctcaacccggaagtgtgcgaggcgaaatctgcctagcaaccggggaagccgggctgtgaagcgggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttggtaccgtcgacagggatcctctagatcaccccccgacca

SEQ ID NO: 316918 - DNA, 1227 bp, Homo sapiens
actcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttct

SEQ ID NO: 316919 - DNA, 2871 bp, Homo sapiens
actcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacaggatgccggctttattaacaaaaactctaacaagtcacctccactatgtgggtcttcctttcccctcaagagaaggagcaattgttcccctgacatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttattttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaatggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttgttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaa

SEQ ID NO: 316920 - DNA, 3733 bp, Homo sapiens
ttgcatgatacaatcgagctctgtacccagcagcatagatactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgacatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttattttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaatggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttgttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaa

SEQ ID NO: 316921 - DNA, 2903 bp, Homo sapiens
actcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagctaccttgggctaatctattgagctaatgaaggatgccggctttattaacaaaaactctaacaagtcacctccactatgtgggtcttcctttcccctcaagagaaggagcaattgttcccctgacatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttattttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaatggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttgttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaa

SEQ ID NO: 316922 - DNA, 509 bp, Homo sapiens
  misc_feature (26)..(26): n is a, c, g, or t
  misc_feature (35)..(35): n is a, c, g, or t
  misc_feature (38)..(38): n is a, c, g, or t
ggtgactcttgagtatccccatcgancatcaaagnacnggaagtaagacaaacatgtatatttttaaatgttctaacataagacctgttctctctagccattgatttaccaggctttctgaaagatctagtggttcacacagagagagagagagtactgaaaaagcaactcctcttgttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaa

SEQ ID NO: 316923 - DNA, 466 bp, Homo sapiens
ggctgcgtgccaggccttggagaacagcacgtccccgctgagtggtgagtgcagctgccgtgggtgtgtggatcgtgtgtgggaagggagcgggcctgctgctgtgtggctcctcaagagctccctccctggcctcctgcccaccgagcacacgcctgtcccggagtcctctctgccccctcctcaggggcgaggaggcgctcactggaaggtcttaactgcaggcccaagggggggctgttcctggccccctcaggggcctcccctacgtgtctctcttcagctgttcagacaattcctgtgggcaagtgtgccaaaacagggcctgcaggaccccagagcttggggccagctgttttccccactctcgtaatagtccacctgaagtagaacccagatttctgaaccctcatcggtgacctttgtttagttattttctggtttacgttttaatacttatagtaaa

SEQ ID NO: 316924 - DNA, 4116 bp, Homo sapiens
actcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgacatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttattttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaatggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttgttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaa

SEQ ID NO: 316925 - DNA, 4062 bp, Homo sapiens
actcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgacatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttattttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaatggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtattcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaa

SEQ ID NO: 316926 - DNA, 1618 bp, Homo sapiens
actcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaatatctatgctgctgggtacagagctcgattgtatcatgtcta

SEQ ID NO: 316927 - DNA, 458 bp, Homo sapiens
agaataaggagaccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtggacaagaagatgcagaagaaaatgaagaaagctcataaaaagatgcacaagcaccaaaagcacc

SEQ ID NO: 316928 - DNA, 423 bp, Homo sapiens
tagtctggaagcgcctacctagcaatatcaaccattaaccttccctctacacttatcatcttcacaattctaattctactgactatcctagaaatcgctgtcgccttaatccaagcctacgttttcacacttctagtaagcttccaggcttgattgcaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtggacaagaagatgcagaagaaaatgaagaaagctcataaaaagatgcacaagcaccaaaagcacc

SEQ ID NO: 316929 - DNA, 2263 bp, Homo sapiens
tgggaaggggctcagcgtgggaaaggatggttgagttttaaccagaggcaaagcgtgagcgggatcagtgtgtgcggaacgcaagcagccgagagcggagaggcgccgctgtagttaactcctccctgcccgccgcgccgaccctccccaggaacccccagggagccagcatgaagcgagctcaccccgagtacagctcctcggacagcgagctggacgagaccatcgaggtggagaaggagagtgcggacgagaatggaaacttgagttcggctctaggttccatgtccccaactacatcttcccagattttggccagaaaaagacggagaggaataattgagaagcgccgacgagaccggatcaataacagtttgtctgagctgagaaggctggtacccagtgcttttgagaagcagggatctgctaagctagaaaaagccgagatcctgcagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttttcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaacctgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagta

SEQ ID NO: 316930 - DNA, 957 bp, Homo sapiens
ctgcaaccaggtgtcgtccacgggcgggggcatgggcatggtgacagtggtcctgttgatgtcaccgatgatgctgagcgcctccttcagcgcgtggtgcatgtgcagcatctcgtcgtgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacacgggcttctataccgcttcgactggaagatccacctccccactgccttttctcactcagatggggacaccgaggtccagaggaaaagacacctgtcaaatgtcacagatctgggaggggacttaagacctatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctctgggagcttcagtt

SEQ ID NO: 316931 - DNA, 2926 bp, Homo sapiens
gcagcttccatggcctggggctgtgagaggcccgggaaggcactgtctttgcgcctgcacatgtgtgtgtctggagtgtaggatggcactggtgccgggcctgggcttcctcgagcgtcccaccggctggaagttgtagacgcggccctggacgtgggtgcgcgccaacaccgggcggcgcgtgctgtagatggagacgcgcgggtctaggctcaccggcggccagggccgcgtctacaacttcctcgagcgtcccaccggctggaaatgcttcgtttaccacttcgccgtcttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacagg

SEQ ID NO: 316932 - DNA, 3131 bp, Homo sapiens
  misc_feature (1)..(2): n is a, c, g, or t
nngcggcggggctggcagcagtggctgcccgcactgcgcccgggcgctcgccttcgctgcagctcccggtgccgccgctcgggccggccccccggcaggccctcctcgttatggccgcggcctcctccccgcccagggccgagaggaagcgctggggttggggccgcctgccaggcgcccggcggggcagcgcgggcctggccaagaagtgccccttctcgctggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtcttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacagg

SEQ ID NO: 316933 - DNA, 6373 bp, Homo sapiens
  misc_feature (298)..(298): n is a, c, g, or t
  misc_feature (380)..(380): n is a, c, g, or t
  misc_feature (386)..(386): n is a, c, g, or t
  misc_feature (400)..(401): n is a, c, g, or t
  misc_feature (432)..(433): n is a, c, g, or t
  misc_feature (677)..(677): n is a, c, g, or t
  misc_feature (2552)..(2552): n is a, c, g, or t
  misc_feature (4712)..(4712): n is a, c, g, or t
cctgctaccagagagccctaggccggctcattggaatagtcatttatttgttccttcattcgttcattcagcatgtccatgttgagcactgactggagcaggtcctgttctggggcctgggaaatgggggtggataagaccaaggtagcctcttctctaaggagctcagccggacctcagcctagagccctggtccccaggagctgaggacagaggtgggacccacaccccccccatgaggccacagagcctgcaggtgtccacaccttttgtttttgttttttgatttttgtttttngttttttgttttttgagatggagtctcactctgtcacccaggctggagtacaatggtgtgatctcggctcactgcaagctcngcctcncgagttcaagcgannctcctgcctcagcctcctgagtagctgggannacagggcgtgcgccaccatgccaggctaatttttgtatttttagtggagacagggtttcaccatgttgatcaggctggtcttgaactcctgaactcgtgatctgcctgcctcggcctcccagagtgctgggattacaggcgtgagcccccgcacctggcccacaccctttctttaccttacacccctgccatctccagtatgcacctgtccgcacacacccacacacccctgaaggatttgacntcatgagccaaaaacatttttgcaaaaggaaagcaactaagctcccagcgtgtctccccttatccattgggcttgtcccaaacacatgccggatggtgtaagtatcattccatcctaattaataacatttgggagccagcgatggcagtgtccagctgactgctcatagtggactccctggtgggggcgtggcatgggagcaaggccagccactgtcacccagtgggagcagaagtcccctccagggcccggcttctgagggaggacaggcaggagtccgccggaagtgggcctgagacgccgtatgcctgtggctttgtggctttgtgtggctagcgcctctcacacgtgggggctggtttcatcttccagccccacacaccttccccaagggcctcccgtacaccccggctgcctgggcgctgggctccagcctgcaggtggccgctgcactttaagtgtcacaatgggctgcacttcacatgaaagctgcattttggcaataagtccccaccaagcccactgagcctggccctgctgcatccacactatacagctgaggaaactgaggcccagctttccacttctgtgcctagggggtgggatccagctccgagggtcttcttcccactcctccaggaacctccgccctctggtgtcggtggagttgaggaggtgttggggtgtggaggggccaggtgactccctgtaagggcaaagtgatccagaggctgcccctaccgcaggtacaccaggctcaaaggccagctgtgaggctttccggggctggatctggtgggaaagtgcttatcacggagggcacccggggttcctggcgtgggaccccctctgacccaggctagggttcctggcgtgggacgccctctggcccaagctggggttcctggtgtggggccccctctgacccaagctggggttcctggcgtcggacgccctctggcccaagctggagttcctggtgtggggccccctctgacccaagctggggttcctggcgtcggacgccctctggcccaagctggggttcctggtgtggggccccctctggccaaggctggggttcctggtgtggggcctcctctggcctgggtgggcctggcctgagagctgcagcctcacctgggctccactgcctatggacatgagctgaagctgctcagccttccagggcctctgtgcgcaggcatcaccatccgcagcaggccaggacccgggcctgctgttctcagggtgtccttcagcggaggctccagcatggctgggttcaaacaggttgcagggtctgaagccactcaaggccgagcctgcctgcagtgagcgtcccactctgtccctgcaggagatcgtgctggtggtgttcttcgggacggagtacgtggtccgcctctggtccgccggctgccgcagcaagtacgtgggcctctgggggcggctgcgctttgcccggaagcccatttccatcatcggtgagtcatgcctgccctgtggaggtcacgcccaggtttccagaccaggaaggacccccacctcatgacccctaccagatggagtcccctaaggactggggaaccccaaggccagcagggggtgactgcccaggacccagcacaggagcattggcagccctcagcagcctctgcactcagacgctgatcatggtgttgggggtagggggttggtccctcacagattcccatgagcctcacagcccagcatagcttcatggtgggccagtcaccctcggcagcctgagaaccatggtccaggcctgaggccctgccctttctggccacttgcagggctcagcacagggcccagcctaggccgggggctccacatggccaggacagaggntgggtctctccgtttagatgctgcctgcctccctatccgaggtgtctccatgtccccggtcatcagggcgtgacccgtctgaccagcaagccccttccccagacgagagcagggtgtatgctcttccctggggccctggctgtggcgatcacgaaaagctccccctctcctgcactccacagacctcatcgtggtcgtggcctccatggtggtcctctgcgtgggctccaaggggcaggtgtttgccacgtcggccatcaggtgcgtctgtgccacaagctccccccgccatgccgccccaccccgagcacccctcctgagccgcgggtggtctcacgccccatccaccttgctcagatgcaaggtgccttggtgcccactgcccccgggggcactgagccatgtgctgggatgggtggagcagggtgggtgcaggcaagtgtggagggcacggctcaacccaagatgcctcaggcagccctaggctctggcccagcactagcgcctctgaacttccaggacttgggtggtaacctgaccatctgggcacacagcctgcccatctgcaaactggggtgacccaaggagccccccagaaggcagtctggggactgagggaatctggaggtacctggccgacccccagctcagccctgtgtgggcagattcagagcaggctctggggggctgcgcctgagagggagattcccaggcccctgtcgggatggacatatacccagcctccccacccagagtggacgcctgggaggggcaggggcagggacacccatgccatcggccagccctaggcccggcgtgaacagctgagcccagcctggctccctcagccccacaccatctccttcgcaggggcatccgcttcctgcagatcctgaggatgctacacgtcgaccgccagggaggcacctggaggctcctgggctccgtggtcttcatccaccgccaggtgggtggcccgggttaggggtgcggggcccaggttggggacaggacggagggagcagagcagcccacactaggacagcttgagatgcgctgaggccccgggggccggtgggtgcctgggcgcaggggtacctgaacggggcccaggatctcagagcaagcccaagcttgagcccagcctggatgctccaccccagcctggtgccagtgaccctggcctgccaggctgatggtgtgctcaccttcctctgagctgggggcaaatgaagacagaaagtcagaaatgaaaaacccaggcaaatcaaggacccggtcaaggcagggccaccagactccctcccgagggctgcactcagatgggttcaggctgcactggcccctggctctgtggggtgaggggacccttcctctccctgaggatctcctgggtcctggtccattcttggttctgtcacgtggcaggaaagagagctgggcaatcagtggagcccgcgccggcccagacagtgggcctagggcgaccccagggctgagcctcattctgggggtaacccccacccgccacttaccggagttgtgaggagtgggctatattgaagccggccctgtgcatgtgaaccgcgctggagcggcgtaggacgcccagtgatcgctgggactcgctgccttaggcgtctgcacaggaggctcccagcctgcggttcctggagcccgacactgtgtgttttctggcctaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtaagtcggaaacttccaggcatggggacaggggcagctcaggctgaggagtgggcaggacatctgggcactggtgtcttgagacttcgggccttggcaggggcttctcacctgcacgctcacaggcctctgtccacaaacctgtgcttggagccgctggcacaggtccccacgctcagtgttgagtcctttggcatcaccatcttgaagttctgaatggtctcatccttgaacttgagatttgagagggaaatcggaggggtcactggagcgtgtgttgggggcttagcggtttcggctcccccatggctctgcntcccgccatcgtcctaggttgcccattccctgcctccaccgtggccctcaccctggcagggcccaaggagagcggcgtcagatgcatacctcgcgtgtctctgagggtccacacaggccctgtaagtgcccctgtccccaaggagccagacatgagacagcaaacaggaaagaccatgatggctcaagagaccccagcagagatcagagagcccccgtgtttccagtggatgctgggcctgcaagttctggagccgggcctgggcagtggcgacataggtgcagctgggcctagggaagcagggacccggcctgtgggcccagaggctgcccctggctgtgaaggtgggttccggccacctagagcagcccgggagccttggggaagccggtgtgcagcaggcagatcccgcactggaacaccgagccacccaaagctcagagaggctgtgcgggaggggtggggcagggtgtcttgggccgtgtctgtgggggcttccttgagggactcaggcttgcacgtgggagagggagatgttccgatgaggatgcagctgcaggaatcagggtgcgccctccgagctgcaggctccccaagtcccaagtcactggcctgtgggcccagcagcagtttctcatggctcagaggacgctggctgaggcatttttagggggcaggcctagcttgccagtgtccctctgggagctggtggctgccttcaaatcctccagtgaaagtcggcgtttatatatgcatggagctcaagggctgcttctagggggaacacgtgggtaccccgaggggagtagctggctggaggccagagtgcagggagggaatgactccatcccatctccccccacagctgcagggccaggtgggccgtccacaggccactaaggcccagggtggcaccatcacaccttggggagtggccctgggtggggaccgagaagcccaagtgccgaggtgacagggtgacccctactctgccgccacaagcctgcccccgcgtctgcccttgtctaccgacctccgggctcactcagtccgataacaggttagatggaatcgtggtagcaacaggggctgggggctggggaggaggccgtcgaagcccacacagggtgggagccaaggcctgggggccgcacgggggctggaggtgggggcgggcagggcagccgtgggaaacacgtggtggtgccaggacccagtccgtctgccccgagtcctccttccagaaaggaccggacttgctggctctcgggaccccccaccaccatcagagcatatctgggtggggtgagaagcctcccggtggctccccaggcaggcacgtgtccctgcgattgctgtgcctcctccctccccctcaaccgccgcttcccccatgaggccagacactcagcagtggctcctgacgtaggccaagtcagcaggttttctggaagcttccaaagtgctgcaatgctcagggatggcaggggcatgctgacacagctcctgggttggggcaggccccactttcggcctcttcccgccttcctgggggcctgtgtccccgaaggccccagtgtggcaggcctgagcaggtttgggcagcagggcccagcccccctgcgggagcctgcctgcagtgagtgtggatgggtagggcg

SEQ ID NO: 316934 - DNA, 851 bp, Homo sapiens
  misc_feature (1)..(2): n is a, c, g, or t
nngcggcggggctggcagcagtggctgcccgcactgcgcccgggcgctcgccttcgctgcagctcccggtgccgccgctcgggccggccccccggcaggccctcctcgttatggccgcggcctcctccccgcccagggccgagaggaagcgctggggttggggccgcctgccaggcgcccggcggggcagcgcgggcctggccaagaagtgccccttctcgctggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtgtgagtatcgccaccggcgacggccggcacgaaggtgcttcctgagagctggtgtgggggagctctgtcccagcgccacctgccccgtcggagctgcgaccccggagcagaggagggaaggaagtggggaaacgcagaaacacaaactctgcactctcccttgaagttcagaggcgctgctgtgtctgggggtgcgcatcttctcgcaggcccggcgtggggagggagccggctggggaggggaccacctggagcccagaatttggctccacacctccgggagggtagtccaggtgtgaatccttctgggaagagaagcgtgctggggagcgcacccttgggtgcagtaagataa

SEQ ID NO: 316935 - DNA, 398 bp, Homo sapiens
  misc_feature (382)..(382): n is a, c, g, or t
  misc_feature (384)..(386): n is a, c, g, or t
  misc_feature (390)..(390): n is a, c, g, or t
  misc_feature (392)..(393): n is a, c, g, or t
  misc_feature (396)..(396): n is a, c, g, or t
  misc_feature (398)..(398): n is a, c, g, or t
gcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggagtaggtaccccgggggtggacagataggcagaggaagggatgggcaggtggatggggggctgaattgtggtcagttatgggtggcgggtagatgggtggacagctggatagatgaagtacngnnngggngnnganan

SEQ ID NO: 316936 - DNA, 2896 bp, Homo sapiens
gcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggacttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacagg

SEQ ID NO: 316937 - DNA, 3015 bp, Homo sapiens
gcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggacttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctatg

SEQ ID NO: 316938 - DNA, 3223 bp, Homo sapiens
  misc_feature (1)..(2): n is a, c, g, or t
nngcggcggggctggcagcagtggctgcccgcactgcgcccgggcgctcgccttcgctgcagctcccggtgccgccgctcgggccggccccccggcaggccctcctcgttatggccgcggcctcctccccgcccagggccgagaggaagcgctggggttggggccgcctgccaggcgcccggcggggcagcgcgggcctggccaagaagtgccccttctcgctggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtattcaagaaattaagcatacggtcacgagagtgcaaagttctgtgaaacgctccagtggttacacgccccggggtttcagcttcgaccctggcttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacagg

SEQ ID NO: 316939 - DNA, 3035 bp, Homo sapiens
  misc_feature (1)..(2): n is a, c, g, or t
nngcggcggggctggcagcagtggctgcccgcactgcgcccgggcgctcgccttcgctgcagctcccggtgccgccgctcgggccggccccccggcaggccctcctcgttatggccgcggcctcctccccgcccagggccgagaggaagcgctggggttggggccgcctgccaggcgcccggcggggcagcgcgggcctggccaagaagtgccccttctcgctggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtcttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcgaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacagg

SEQ ID NO: 316940 - DNA, 2759 bp, Homo sapiens
gcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggacttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgacccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacagg

SEQ ID NO: 316941 - DNA, 2406 bp, Homo sapiens
actctagaggatctctggtcgctgtatcgggggctccaaggggcagagtgtttgccacgtcggcatcagggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacagg

SEQ ID NO: 316942 - DNA, 2081 bp, Homo sapiens
  misc_feature (1)..(2): n is a, c, g, or t
nngcggcggggctggcagcagtggctgcccgcactgcgcccgggcgctcgccttcgctgcagctcccggtgccgccgctcgggccggccccccggcaggccctcctcgttatggccgcggcctcctccccgcccagggccgagaggaagcgctggggttggggccgcctgccaggcgcccggcggggcagcgcgggcctggccaagaagtgccccttctcgctggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtcttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacatctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacagg

SEQ ID NO: 316943 - DNA, 1530 bp, Homo sapiens
caacagcagccacggctcatagtgtgggctggtgtaacgggggcagtggaatggctgtgcccccagcctggagtcaggcctgtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctgaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacagg

SEQ ID NO: 316944 - DNA, 1378 bp, Homo sapiens
  misc_feature (1)..(2): n is a, c, g, or t
nngcggcggggctggcagcagtggctgcccgcactgcgcccgggcgctcgccttcgctgcagctcccggtgccgccgctcgggccggccccccggcaggccctcctcgttatggccgcggcctcctccccgcccagggccgagaggaagcgctggggttggggccgcctgccaggcgcccggcggggcagcgcgggcctggccaagaagtgccccttctcgctggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtcttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtgagtagcccacctgc

SEQ ID NO: 316945 - DNA, 5121 bp, Homo sapiens
ggcccgagccaccgactgcaggaggagaaggggttgtgctcctggccgaggaaggagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaagcaggacagaaggagcaagctgtggaatggtataagaaaggtattgaagaactggaaaaaggaatagctgttatagttacaggacaaggtgaacagtgtgaaagagctagacgccttcaagctaaaatgatgactaatttggttatggccaaggaccgcttacaacttctagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataagggtactccgaaaacaaataggacaaataaaccttctacccctacaactgctactcgtaagaaaaaagacttgaagaattttaggaatgtggacagcaaccttgctaaccttataatgaatgaaattgtggacaatggaacagctgttaaatttgatgatatagctggtcaagacttggcaaaacaagcattgcaagaaattgttattcttccttctctgaggcctgagttgttcacagggcttagagctcctgccagagggctgttactctttggtccacctgggaatgggaagacaatgctggctaaagcagtagctgcagaatcgaatgcaaccttctttaatataagtgctgcaagtttaacttcaaaatacgtgggagaaggagagaaattggtgagggctctttttgctgtggctcgagaacttcaaccttctataatttttatagatgaagttgatagccttttgtgtgaaagaagagaaggggagcacgatgctagtagacgcctaaaaactgaatttctaatagaatttgatggtgtacagtctgctggagatgacagagtacttgtaatgggtgcaactaataggccacaagagcttgatgaggctgttctcaggcgtttcatcaaacgggtatatgtgtctttaccaaatgaggagacaagactacttttgcttaaaaatctgttatgtaaacaaggaagtccattgacccaaaaagaactagcacaacttgctagaatgactgatggatactcaggaagtgacctaacagctttggcaaaagatgcagcactgggtcctatccgagaactaaaaccagaacaggtgaagaatatgtctgccagtgagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctggggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctctaacattacaacatcaattatgaaatactgataacgaaaggtagtaatgaaatatatatgatgaaaagaattgagaagttctaaattaagacatttcagttaagctcataaaatttcattgttttcatttaaaaggagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaacttta

SEQ ID NO: 316946 - DNA, 555 bp, Homo sapiens
tgaatattatattttaaaagcttttcctgtcatttgctgtttcagctttaaattcaaaattatatttctaaaagtgctggatttttttttttaggcgtttcatcaaacgggtatatgtgtctttaccaaatgaggaggtatgtatctgtgtttgaattttttttgttttagagcagaaacaagaactaccatcttgacaatattaagtcttccaatccatggtacagctactttggaaaacagtttagtggtttcttaaaaagatgtacataagcttactgtcagagccagcaatttcactcctaagaatttaccccagagaaacaaaaatgtatgtccacacaaagacttgtacaagaatttttatagcagcaatattaataatagccagaactacaaatgatctaaaatgtttattttggtgaataaacaaatgtggtatattcatttaatggatactgttatccattatacatgctgcatactcacttcatatattaagttttatgaatgaaatccagcctgggtaacagcacaagaccctgtctcaatata

SEQ ID NO: 316947 - DNA, 5217 bp, Homo sapiens
ggcccgagccaccgactgcaggaggagaaggggttgtgctcctggccgaggaaggagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaagcaggacagaaggagcaagctgtggaatggtataagaaaggtattgaagaactggaaaaaggaatagctgttatagttacaggacaaggtgaacagtgtgaaagagctagacgccttcaagctaaaatgatgactaatttggttatggccaaggaccgcttacaacttctagagaagatgcaaccagttttgccattttccaagtcacaaacggacgtctataatgacagtactaacttggcatgccgcaatggacatctccagtcagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataagggtactccgaaaacaaataggacaaataaaccttctacccctacaactgctactcgtaagaaaaaagacttgaagaattttaggaatgtggacagcaaccttgctaaccttataatgaatgaaattgtggacaatggaacagctgttaaatttgatgatatagctggtcaagacttggcaaaacaagcattgcaagaaattgttattcttccttctctgaggcctgagttgttcacagggcttagagctcctgccagagggctgttactctttggtccacctgggaatgggaagacaatgctggctaaagcagtagctgcagaatcgaatgcaaccttctttaatataagtgctgcaagtttaacttcaaaatacgtgggagaaggagagaaattggtgagggctctttttgctgtggctcgagaacttcaaccttctataatttttatagatgaagttgatagccttttgtgtgaaagaagagaaggggagcacgatgctagtagacgcctaaaaactgaatttctaatagaatttgatggtgtacagtctgctggagatgacagagtacttgtaatgggtgcaactaataggccacaagagcttgatgaggctgttctcaggcgtttcatcaaacgggtatatgtgtctttaccaaatgaggagacaagactacttttgcttaaaaatctgttatgtaaacaaggaagtccattgacccaaaaagaactagcacaacttgctagaatgactgatggatactcaggaagtgacctaacagctttggcaaaagatgcagcactgggtcctatccgagaactaaaaccagaacaggtgaagaatatgtctgccagtgagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctggggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctctaacattacaacatcaattatgaaatactgataacgaaaggtagtaatgaaatatatatgatgaaaagaattgagaagttctaaattaagacatttcagttaagctcataaaatttcattgttttcatttaaaaggagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaacttta

SEQ ID NO: 316948 - DNA, 5676 bp, Homo sapiens
ggcccgagccaccgactgcaggaggagaaggggttgtgctcctggccgaggaaggagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaagcaggacagaaggagcaagctgtggaatggtataagaaaggtattgaagaactggaaaaaggaatagctgttatagttacaggacaaggtgaacagtgtgaaagagctagacgccttcaagctaaaatgatgactaatttggttatggccaaggaccgcttacaacttctagagaagatgcaaccagttttgccattttccaagtcacaaacggacgtctataatgacagtactaacttggcatgccgcaatggacatctccagtcagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataagggtactccgaaaacaaataggacaaataaaccttctacccctacaactgctactcgtaagaaaaaagacttgaagaattttaggaatgtggacagcaaccttgctaaccttataatgaatgaaattgtggacaatggaacagctgttaaatttgatgatatagctggtcaagacttggcaaaacaagcattgcaagaaattgttattcttccttctctgaggcctgagttgttcacagggcttagagctcctgccagagggctgttactctttggtccacctgggaatgggaagacaatgctggctaaagcagtagctgcagaatcgaatgcaaccttctttaatataagtgctgcaagtttaacttcaaaatacgtgggagaaggagagaaattggtgagggctctttttgctgtggctcgagaacttcaaccttctataatttttatagatgaagttgatagccttttgtgtgaaagaagagaaggggagcacgatgctagtagacgcctaaaaactgaatttctaatagaatttgatggtgtacagtctgctggagatgacagagtacttgtaatgggtgcaactaataggccacaagagcttgatgaggctgttctcaggcgtttcatcaaacgggtatatgtgtctttaccaaatgaggagacaagactacttttgcttaaaaatctgttatgtaaacaaggaagtccattgacccaaaaagaactagcacaacttgctagaatgactgatggatactcaggaagtgacctaacagctttggcaaaagatgcagcactgggtcctatccgagaactaaaaccagaacaggtgaagaatatgtctgccagtgagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctggggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctctaacattacaacatcaattatgaaatactgataacgaaaggtagtaatgaaatatatatgatgaaaagaattgagaagttctaaattaagacatttcagttaagctcataaaatttcattgttttcatttaaaaggagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaactttaaaaaaaaaaaaaacaaacaaaaaaacaacacactttcgggcgacccactcggcccccgcgaaaaccctctcacaaacacacatcgcgcaatgagggagcacggcgagcccaacgagacgagacacctgaccaccagctggacacaacacggtttctccagagaggagaacacacgggggacacgagcacacaagcgcgagcagtcgagagtaatgaccccaaccacgagtatacagaaaaaagcgccaccgcggcggcgcgaacaaacacgagagaaggcgcatcttccgacgaacacacaaaactaccacgacagcaggcgcagatacccagagaagaggagcacactaaacaggacgcacgatctcatacacaaagcgaggaaggccctacagcggacaccacagacggccaaataaattacgcaaacaaataaaagcccgcgccacccgcgcggcg

SEQ ID NO: 316949 - DNA, 4458 bp, Homo sapiens
ggcccgagccaccgactgcaggaggagaaggggttgtgctcctggccgaggaaggagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaagcaggacagaaggagcaagctgtggaatggtataagaaaggtattgaagaactggaaaaaggaatagctgttatagttacaggacaaggtgaacagtgtgaaagagctagacgccttcaagctaaaatgatgactaatttggttatggccaaggaccgcttacaacttctagagaagatgcaaccagttttgccattttccaagtcacaaacggacgtctataatgacagtactaacttggcatgccgcaatggacatctccagtcagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataagggtactccgaaaacaaataggacaaataaaccttctacccctacaactgctactcgtaagaaaaaagacttgaagaattttaggaatgtggacagcaaccttgctaaccttataatgaatgaaattgtggacaatggaacagctgttaaatttgatgatatagctggtcaagacttggcaaaacaagcattgcaagaaattgttattcttccttctctgaggcctgagttgttcacagggcttagagctcctgccagagggctgttactctttggtccacctgggaatgggaagacaatgctggctaaagcagtagctgcagaatcgaatgcaaccttctttaatataagtgctgcaagtttaacttcaaaatacgtgggagaaggagagaaattggtgagggctctttttgctgtggctcgagaacttcaaccttctataatttttatagatgaagttgatagccttttgtgtgaaagaagagaaggggagcacgatgctagtagacgcctaaaaactgaatttctaatagaatttgatggtgtacagtctgctggagatgacagagtacttgtaatgggtgcaactaataggccacaagagcttgatgaggctgttctcaggcgtttcatcaaacgggtatatgtgtctttaccaaatgaggagacaagactacttttgcttaaaaatctgttatgtaaacaaggaagtccattgacccaaaaagaactagcacaacttgctagaatgactgatggatactcaggaagtgacctaacagctttggcaaaagatgcagcactgggtcctatccgagaactaaaaccagaacaggtgaagaatatgtctgccagtgagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctggggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctctaacattacaacatcaattatgaaatactgataacgaaaggtagtaatgaaatatatatgatgaaaagaattgagaagttctaaattaagacatttcagttaagctcataaaatttcattgttttcatttaaaaggagattaacgttattgatacttggataactggctaatcatattaaaggactatgtggttccagctcaacttttaatatattgtctcctttaaaactatcatggttataattctattcgttaattgatataaaaaaaaaacgacaaaattaggcttgtaaaactgactttttcatacgtgggttttgaatctagccccagacagacataatgtaggaataca

SEQ ID NO: 316950 - DNA, 3874 bp, Homo sapiens
aaattaaaacacaatactgctgggtgcagtggctcacacctgtaatcccagcactttgggaggccgaggtgggcagatcacctgatgtcaggggttcaagaccagcctgaccaatatggtgaaaccccatctctactaaaaatacaaaaattagctgggcatggtggcgggtgcctgtaatctcagctactcaggaggctgaggcaggagaatcgcttgaacccaggaggcagaggttgcagtgagccaagatcgcgccattgcactccagcctgggggacagagcaagactccgtctcaaaaaattttctataaatgattgtgttttgtttttatattggaaaaatattatgctttcaaatgttaatacctatgaaactaaacacaagtaataaatatattagtatagcatttattaaggtttcttgtgtagcagatcaacatagaaaatatatttaaatggctgacataattttctaagaatacatacacgtatattttttataacattaagaaacagcagcatcattactttaatccatcatttcgttaaccaccatatacctgttgatcatttgtattgtcatgtgctttttaaaaatctagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctggggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctctaacattacaacatcaattatgaaatactgataacgaaaggtagtaatgaaatatatatgatgaaaagaattgagaagttctaaattaagacatttcagttaagctcataaaatttcattgttttcatttaaaaggagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaacttta

SEQ ID NO: 316951 - DNA, 3368 bp, Homo sapiens
  misc_feature (3346)..(3346): n is a, c, g, or t
  misc_feature (3360)..(3360): n is a, c, g, or t
  misc_feature (3362)..(3362): n is a, c, g, or t
ggcccgagccaccgactgcaggaggagaaggggttgtgctcctggccgaggaaggagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaagcaggacagaaggagcaagctgtggaatggtataagaaaggtattgaagaactggaaaaaggaatagctgttatagttacaggacaaggtgaacagtgtgaaagagctagacgccttcaagctaaaatgatgactaatttggttatggccaaggaccgcttacaacttctagagaagatgcaaccagttttgccattttccaagtcacaaacggacgtctataatgacagtactaacttggcatgccgcaatggacatctccagtcagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataagggtactccgaaaacaaataggacaaataaaccttctacccctacaactgctactcgtaagaaaaaagacttgaagaattttaggaatgtggacagcaaccttgctaaccttataatgaatgaaattgtggacaatggaacagctgttaaatttgatgatatagctggtcaagacttggcaaaacaagcattgcaagaaattgttattcttccttctctgaggcctgagttgttcacagggcttagagctcctgccagagggctgttactctttggtccacctgggaatgggaagacaatgctggctaaagcagtagctgcagaatcgaatgcaaccttctttaatataagtgctgcaagtttaacttcaaaatacgtgggagaaggagagaaattggtgagggctctttttgctgtggctcgagaacttcaaccttctataatttttatagatgaagttgatagccttttgtgtgaaagaagagaaggggagcacgatgctagtagacgcctaaaaactgaatttctaatagaatttgatggtgtacagtctgctggagatgacagagtacttgtaatgggtgcaactaataggccacaagagcttgatgaggctgttctcaggcgtttcatcaaacgggtatatgtgtctttaccaaatgaggagacaagactacttttgcttaaaaatctgttatgtaaacaaggaagtccattgacccaaaaagaactagcacaacttgctagaatgactgatggatactcaggaagtgacctaacagctttggcaaaagatgcagcactgggtcctatccgagaactaaaaccagaacaggtgaagaatatgtctgccagtgagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcatggcctcgttggcntcagcggtggagtntncggccg

SEQ ID NO: 316952 - DNA, 1367 bp, Homo sapiens
  misc_feature (1345)..(1345): n is a, c, g, or t
  misc_feature (1359)..(1359): n is a, c, g, or t
  misc_feature (1361)..(1361): n is a, c, g, or t
aaattaaaacacaatactgctgggtgcagtggctcacacctgtaatcccagcactttgggaggccgaggtgggcagatcacctgatgtcaggggttcaagaccagcctgaccaatatggtgaaaccccatctctactaaaaatacaaaaattagctgggcatggtggcgggtgcctgtaatctcagctactcaggaggctgaggcaggagaatcgcttgaacccaggaggcagaggttgcagtgagccaagatcgcgccattgcactccagcctgggggacagagcaagactccgtctcaaaaaattttctataaatgattgtgttttgtttttatattggaaaaatattatgctttcaaatgttaatacctatgaaactaaacacaagtaataaatatattagtatagcatttattaaggtttcttgtgtagcagatcaacatagaaaatatatttaaatggctgacataattttctaagaatacatacacgtatattttttataacattaagaaacagcagcatcattactttaatccatcatttcgttaaccaccatatacctgttgatcatttgtattgtcatgtgctttttaaaaatctagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattggcctcgttggcntcagcggtggagtntncggccg

SEQ ID NO: 316953 - DNA, 532 bp, Homo sapiens
taatatatcgagactaatttaatatttgctcttgtgatttttaaaggctaaagcagtagctgcagaatcgaatgcaaccttctttaatataagtgctgcaagtttaacttcaaaatacgtgagtgctctgtttccaatattgtcgtattttaagttactgtctaaatgttactgtgttaactgtaaatggtaatatttcatgaaaatatttttctaggagcttatctattgtatctattatttacatatgatgaatatctatcttcagagtagaaagttatgtacatttgtgttgtcaaatactgtattagtttactggggccatgtaataaaataccgtaaactggctggcttaaacatcagcaatttattgtctcacagttgtggaaggtagaagtctaagatcagtcaaaatgttggcagggttgcttcctcctgagggctgtgagggaaaatgtatgttgtgtgcctctctcctggcttctggtggcttgctggcaatcttttgtattccttggcttgtagatgcatc

SEQ ID NO: 316954 - DNA, 549 bp, Homo sapiens
cgagactaatttaatatttgctcttgtgatttttaaaggctaaagcagtagctgcagaatcgaatgcaaccttctttaatataagtgctgcaagtttaacttcaaaatacgtgagtgctctgtttccaatattgtcgtattttaagttactgtctaaatgttactgtgttaactgtaaatggtaatatttcatgaaaatatttttctaggagcttatctattgtatctattatttacatatgatgaatatctatcttcagagtagaaagttatgtacatttgtgttgtcaaatactgtattagtttactggggccatgtaataaaataccgtaaactggctggcttaaacatcagcaatttattgtctcacagttgtggaaggtagaagtctaagatcagtcaaaatgttggcagggttgcttcctcctgagggctgtgagggaaaatgtatgttgtgtgcctctctcctggcttctggtggcttgctggcaatcttttgtattccttggcttgtagatgcatccctcctatctctgtctttatcttta

SEQ ID NO: 316955 - DNA, 1561 bp, Homo sapiens
aagttattggggttttctctcttgaagggtctcattttaattcccttttccaggccgtatagatcaaatatagtactgtcattactgttggctcttgttttggtcttgacttactaatagtgttaccctgattttcagagggggacagtttatctccagaaaggccaatgtttgtatacacatcagctagacacaaatatagacatcatatgtagtttgtacatgtttcagaaacttgttttttctttgctctgtgtaacctatttcctattgctagttcagttggctttcttattcacttctgtgaccctgaaccagttctcagaccctagagtgtaagagcattgattttctacgctgtgtaatctagctcaatccctctgtcccctccgcctcaccgtcccccagccaccacattgtatagcaaaagcattacattcaatcctagaataaaggtaaatacaacaaatcatctttgcagctggacaactaataatactttgcagcattaagagatcttctgtgttaccagtcactctgttgaaatgaactttccgaatctctttattcaggaaaacatggggttttgaaattcttgggccaagagacataactgaggggttcgcagagctaggcaagggtgcactaggaaagggccacattggtgggtggggggtaacagagaacagatggtgtcaggaagtttctctggagtaaataatgtggatattcttggtttccctctcctccgccagctgaagctgtgttagtgctgttgacactaatataaaatgtttggtccatttgaaatccttgtcattgccttatatgggggaaactcaatcccccagcctgtgttggaaatatcaccaaactgattgtaaatgtgcggctgtacagacattttagtgtggtggtgtgcaccatttcggccctacacctgcagcctggctacttacagttgtgttccgattttgcgtctatgcttggtgtgcctcacttgctgcattttccagcatgcaaccaggagttgacgtaggaaaaagggatgctttcttactttggaagctctcagggaagttggtgtcaatttctcctccactgcctggcctaccctgcactcccaaagattttgtgcagatgggtagttccattttttaaaaattgtgcagatatggaaaattgtgacttacttcatgaccagaactatctagaatatgtgtgggggtataaacatcttgcttaaccaaatatctatgtaggcagaggtaaccaggagagaagcaagacttgctgcctaaaggagcccaccattttacttttcacatttaatctgccacgttgaatcaattggaataaaacctgactcgcaggtgactggacaggaaatcccaaagttccaccatttctatgcttaattttaacgtccccccgcttttttttttgtagaaaataaaaacaagaaaatcgttccaatgtaagatgtttgttatagaaactttaggcaatacaggtgtgtaataaaatgtttaataaacttctaaacacttttgtatttgga

SEQ ID NO: 316956 - DNA, 1247 bp, Homo sapiens
  misc_feature (1026)..(1027): n is a, c, g, or t
  misc_feature (1029)..(1029): n is a, c, g, or t
  misc_feature (1033)..(1033): n is a, c, g, or t
  misc_feature (1036)..(1036): n is a, c, g, or t
  misc_feature (1038)..(1038): n is a, c, g, or t
  misc_feature (1043)..(1043): n is a, c, g, or t
  misc_feature (1055)..(1055): n is a, c, g, or t
  misc_feature (1063)..(1063): n is a, c, g, or t
  misc_feature (1067)..(1067): n is a, c, g, or t
  misc_feature (1086)..(1086): n is a, c, g, or t
  misc_feature (1088)..(1088): n is a, c, g, or t
  misc_feature (1093)..(1093): n is a, c, g, or t
  misc_feature (1096)..(1096): n is a, c, g, or t
  misc_feature (1105)..(1105): n is a, c, g, or t
  misc_feature (1107)..(1107): n is a, c, g, or t
aagttattggggttttctctcttgaagggtctcattttaattcccttttccaggccgtatagatcaaatatagtactgtcattactgttggctcttgttttggtcttgacttactaatagtgttaccctgattttcagagggggacagtttatctccagaaaggccaatgtttgtatacacatcagctagacacaaatatagacatcatatgtagtttgtacatgtttcagaaacttgttttttctttgctctgtgtaacctatttcctattgctagttcagttggctttcttattcacttctgtgaccctgaaccagttctcagaccctagagtgtaagagcattgattttctacgctgtgtaatctagctcaatccctctgtcccctccgcctcaccgtcccccagccaccacattgtatagcaaaagcattacattcaatcctagaataaaggtaaatacaacaaatcatctttgcagctggacaactaataatactttgcagcattaagagatcttctgtgttaccagtcactctgttgaaatgaactttccgaatctctttattcaggaaaacatggggttttgaaattcttgggccaagagacataactgaggggttcgcagagctaggcaagggtgcactaggaaagggccacattggtgggtggggggtaacagagaacagatggtgtcaggaagtttctctggagtaaataatgtggatattcttggtttccctctcctccgccagctgaagctgtgttagtgctgttgacactaatataaaatgtttggtccatttgaaatccttgtcattgccttatatgggggaaactcaatcccccagcctgtgttggaaatatcaccaaactgattgtaaatgtgcggctgtacagacattttagtgtggtggtgtgcaccatttcggccctacacctgcagcctggctacttacagttgtgttccgattttgcgtctatgcttggtgtgcctcacttgctgcattttccagcatgcacagnntncgtnganangatcntctacttgaccntagagtgngcantcccatgctgcactgatcnanattgnaangagtcattnantgcgaagaattcgttctgcgaaaactagaaagtggggggcactcacttggcgggaatcctgcgcttttttccgggtacacaggggaaccattttcctttaaacaggtagggactctaaacagtgggccccctcgttgacg

SEQ ID NO: 316957 - DNA, 1387 bp, Homo sapiens
gacaggcggatcatctgaggtcaggagtttgagaccagcctcgccaacatggtgaaaccccatctcgatgcggccacggcttgggcgggactaaggctgggaacgagccaccgattggtcagagctacgcggcgaatggcggagacgctgaggcgggtgctaaccaggggcggtgcggcctggtccggggaggagaacatgcctgccgccggaccgcctttgctgctgctcggtacaccaggatctggaaaaacagcgctgctatttgctgcggccctagaggcggcgggggagggccaaggcccagtcctcttcctgacacgaaggcctcttcaaagcatgccccgcgggaccggaacgactctagacccaatgcgactccagaagatccgcttccagtacccaccctcaacccgagagcttttccggctcctgtgctctgcccatgaggccccggggccagccccctcccttctgctgctcgacggcctagaagagtacctagcggaagacccagagccccaggaagccgcctacctcattgccttacttctagacacagctgcccacttcagccaccggcttgggcctggccgggattgtgggctcatggtggccctccagacccaggaggaagcaggtagtggggacgtcctgcacctggcactgctccagcggtattttcctgcccagtgctggctgcagccagatgcaccaggtccaggagagcacggcctccgagcctgcctggagccaggcgggctgggccccagaacagagtggtgggtgactttccgatcagatggagaaatgatgatcgctccgtggcccacccaggctggtgaccccagctcaggcaagggttcaagctctggaggccagccctgagctttggtgggtgactacctctctgtgcttcagtttcccatggctggaatacttacctcagggacatatgcagatccaaagacctaaacaatgtaaagtgctttttctcttttaaaagtatagcattatcttgtatatattttacccaatcaatatgttgtttatagtttcattgctttaaactttataaaaagagcttcaggccaggcgtggtggctcacgcctgtaatcccagcactttgggaggctgaggcggtcagatcaccagaggtcaggagttggagaccagcctgcccaacatgatgaaaccctgtatcaactaaaagtacaaaaaaaattagctgggtgtggtggcaggtgcctgtagtctcagctactcaggaggcttaggcaggagaattgcttgaacccaggaagcggaggttgcagtgagccgagattgtgccactacactccagcctgggtgacaaagcgagactccatctcaaaaaaaaaaaaa

SEQ ID NO: 316958 - DNA, 1285 bp, Homo sapiens
agcgggtcaaggatggggtcagaccgagaatgctgggggagggttttccgtggaaaaattgcgctagagatttggccaaaaacaaacaagcaaaaatggcttgccctcaactaatactcggcagtgatgagtgctggaaaaacgggcgaatataagaatatttaacagctctgaactggttcatcctggaaccaaggaaagtatgcaaggaggcagggttacttttaaggagtctggcttcctgtgctgaatccggccctttccttctgtttctccttctagaagatccgcttccagtacccaccctcaacccgagagcttttccggctcctgtgctctgcccatgaggccccggggccagccccctcccttctgctgctcgacggcctagaagagtacctagcggaagacccagagccccaggaagccgcctacctcattgccttacttctagacacagctgcccacttcagccaccggcttgggcctggccgggattgtgggctcatggtggccctccagacccaggaggaagcaggtagtggggacgtcctgcacctggcactgctccagcggtattttcctgcccagtgctggctgcagccagatgcaccaggtccaggagagcacggcctccgagcctgcctggagccaggcgggctgggccccagaacagagtggtgggtgactttccgatcagatggagaaatgatgatcgctccgtggcccacccaggctggtgaccccagctcaggcaagggttcaagctctggaggccagccctgagctttggtgggtgactacctctctgtgcttcagtttcccatggctggaatacttacctcagggacatatgcagatccaaagacctaaacaatgtaaagtgctttttctcttttaaaagtatagcattatcttgtatatattttacccaatcaatatgttgtttatagtttcattgctttaaactttataaaaagagcttcaggccaggcgtggtggctcacgcctgtaatcccagcactttgggaggctgaggcggtcagatcaccagaggtcaggagttggagaccagcctgcccaacatgatgaaaccctgtatcaactaaaagtacaaaaaaaattagctgggtgtggtggcaggtgcctgtagtctcagctactcaggaggcttaggcaggagaattgcttgaacccaggaagcggaggttgcagtgagccgagattgtgccactacactccagcctgggtgacaaagcgagactccatctcaaaaaaaaaaaaa

SEQ ID NO: 316959 - DNA, 1293 bp, Homo sapiens
gacaggcggatcatctgaggtcaggagtttgagaccagcctcgccaacatggtgaaaccccatctcgatgcggccacggcttgggcgggactaaggctgggaacgagccaccgattggtcagagctacgcggcgaatggcggagacgctgaggcgggtgctaaccaggggcggtgcggcctggtccggggaggagaacatgcctgccgccggaccgcctttgctgctgctcggtacaccaggatctggaaaaacagcgctgctatttgctgcggccctagaggcggcgggggagggccaaggcccagtcctcttcctgacacgaaggcctcttcaaagcatgccccgcgggaccggaacgactctagacccaatgcgactccagaagatccgcttccagtacccaccctcaacccgagagcttttccggctcctgtgctctgcccatgaggccccggggccagccccctcccttctgctgctcgacggcctagaagagtacctagcggaagacccagagcccccctccagacccaggaggaagcaggtagtggggacgtcctgcacctggcactgctccagcggtattttcctgcccagtgctggctgcagccagatgcaccaggtccaggagagcacggcctccgagcctgcctggagccaggcgggctgggccccagaacagagtggtgggtgactttccgatcagatggagaaatgatgatcgctccgtggcccacccaggctggtgaccccagctcaggcaagggttcaagctctggaggccagccctgagctttggtgggtgactacctctctgtgcttcagtttcccatggctggaatacttacctcagggacatatgcagatccaaagacctaaacaatgtaaagtgctttttctcttttaaaagtatagcattatcttgtatatattttacccaatcaatatgttgtttatagtttcattgctttaaactttataaaaagagcttcaggccaggcgtggtggctcacgcctgtaatcccagcactttgggaggctgaggcggtcagatcaccagaggtcaggagttggagaccagcctgcccaacatgatgaaaccctgtatcaactaaaagtacaaaaaaaattagctgggtgtggtggcaggtgcctgtagtctcagctactcaggaggcttaggcaggagaattgcttgaacccaggaagcggaggttgcagtgagccgagattgtgccactacactccagcctgggtgacaaagcgagactccatctcaaaaaaaaaaaaa

SEQ ID NO: 316960 - DNA, 287 bp, Homo sapiens
gcgagcagcccactagcatgccttatgagcctgatgatcaaacttctgagcgatcagattcctgaaagagcagtctctccatgacaaaagatggatttggaaatgagaaagcaatttctgtaaaacttctgcacctgtggtagactcagaaacacacacaaggctataaatgtctttatgcacttattaattttccaataaacatactcaacagtacacctaatagggaagttctgtgattaatttttcaaacaataagaaaataaatgatcagaaaggcttacagt

SEQ ID NO: 316961 - DNA, 294 bp, Homo sapiens
agacacacagctcctgtcctgggaagctgattctgagggcgggaccctgcccctaccccagggagcccagagtctgaggggagacgccatctcagccctgccctgttccttccttttggactaatggctgagtgacccaactggatttccttggcttgaacctgagcaagccctctctctctaaagacttgaatgcctactcccttcactgagtggtttcttctgttcctggccaactcagtgagaaagcaatcatctgcaagccgggaagagagccctcatcagaactcaacc

SEQ ID NO: 316962 - DNA, 503 bp, Homo sapiens
agacacacagctcctgtcctgggaagctgattctgagggcgggaccctgcccctaccccagggagcccagagtctgaggggagacgccatctcagccctgccctgttccttccttttggactaatggctgagtgacccaactggatttccttggcttgaacctgagcaagccctctctctctaaagacttgaatgcctactcccttcactgagtggtttcttctgttcctggccaactcagtgagcctgatgatcaaacttctgagcgatcagattcctgaaagagcagtctctccatgacaaaagatggatttggaaatgagaaagcaatttctgtaaaacttctgcacctgtggtagactcagaaacacacacaaggctataaatgtctttatgcacttattaattttccaataaacatactcaacagtacacctaatagggaagttctgtgattaatttttcaaacaataagaaaataaatgatcagaaaggcttacagt

SEQ ID NO: 316963 - DNA, 10411 bp, Homo sapiens
taggagccggaggaggagccgccgccgccgttgacccggccgccggccgggagctgggagagatgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtgagaagcgctatgtggtccaggtgagggaggatgtgactccaggggccccagtactccgagtcacagcctcggatcgagacaaggggagcaatgccgtggtgcactatagcatcatgagtggcaatgctcggggacagttttatctggatgcccagactggagctctggatgtggtgagccctcttgactatgagacgaccaaggagtacaccctacgggtgcgagcacaggatggtggccgtcccccactctctaatgtctctggcttggtgacagtacaggtcctggatatcaacgacaatgcccccatcttcgtcagcacccctttccaggctactgtcctggagagcgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactacgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtcttccagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcctggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccagagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggcggcccccctccccgcccaccgccccggcagagcctccaggagcagctgaacggggtcatgcccatcgccatgagcatcaaggcaggcacggtggatgaggactcgtcaggctccgacagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgtctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgcgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctccccctgtcttctcccctcagcaattcctgcaaagggttaaaaatttaactggtttttactactgatgacttgatttaaaaaaaatacaaagatgctggatgctaacttgatactaaccatcagattgtacagtttggttgttgctgtaaatatggtagcgttttgttgttgttgttttttcatgccccatactactgaataaactagttctgtgcgggtacagcaatgtcact

SEQ ID NO: 316964 - DNA, 5003 bp, Homo sapiens
  misc_feature (4)..(5): n is a, c, g, or t
tgcnntgctgcctgcggtcgcttagaggatccccgcattcctgcctttgccatttgggaagccgaggcaggactgcttaagcccaggagttcaagaccaacttgggcaacatggcgaaaccctgtctctacaaaaaatacaaaaagtagacagatgtggtggtatgtgcctatggtcccagctactcaggaggctgaggtgggaggactgcttgagcccaggggattgaggctgcagagagctgtgatcatgccactgcattccaaatcggcaaagtgcaggaattggcgccaattcctgcactttgccgatttggactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggcggcccccctccccgcccaccgccccggcagagcctccaggagcagctgaacggggtcatgcccatcgccatgagcatcaaggcaggcacggtggatgaggactcgtcaggctccgacagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgtctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgcgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctccccctgtcttctcccctcagcaattcctgcaaagggttaaaaatttaactggtttttactactgatgacttgatttaaaaaaaatacaaagatgctggatgctaacttgatactaaccatcagattgtacagtttggttgttgctgtaaatatggtagcgttttgttgttgttgttttttcatgccccatactactgaataaactagttctgtgcgggtacagcaatgtcact

SEQ ID NO: 316965 - DNA, 4989 bp, Homo sapiens
  misc_feature (9)..(9): n is a, c, g, or t
  misc_feature (19)..(19): n is a, c, g, or t
  misc_feature (30)..(30): n is a, c, g, or t
gctttttgntgccccgctntcgactctagncgatccccgccaattcctgcactttgccgatttgggaatgtgagtgtcctactgtggtaaatggaatttctgaaatgggtccccaaacatgccacacccctgtctctaaagcctcttaaggtgatgagacaccattcctgtgactatgttgttatatgccagttatatgactttaagatggtgaggttaccgcatgaactggatctaatcacatcactccaaatcggcaaagtgcaggaattggcgccaattcctgcactttgccgatttggactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggcggcccccctccccgcccaccgccccggcagagcctccaggagcagctgaacggggtcatgcccatcgccatgagcatcaaggcaggcacggtggatgaggactcgtcaggctccgacagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgtctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgcgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctccccctgtcttctcccctcagcaattcctgcaaagggttaaaaatttaactggtttttactactgatgacttgatttaaaaaaaatacaaagatgctggatgctaacttgatactaaccatcagattgtacagtttggttgttgctgtaaatatggtagcgttttgttgttgttgttttttcatgccccatactactgaataaactagttctgtgcgggtacagcaatgtcact

SEQ ID NO: 316966 - DNA, 1777 bp, Homo sapiens
cttttctgccactttcctttcctgcctctccagatttctcttctttaacttcctgcattaaccctgggccgtggttcctacgcccgaggctcccttcccttccccagccgcactcatgccctgctcctgtcttgtgctttatcctgccccgctccccatcgcctgcccgcagcagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgtctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgcgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctccccctgtcttctcccctcagcaattcctgcaaagggttaaaaatttaactggtttttactactgatgacttgatttaaaaaaaatacaaagatgctggatgctaacttgatactaaccatcagattgtacagtttggttgttgctgtaaatatggtagcgttttgttgttgttgttttttcatgccccatactactgaataaactagttctgtgcgggtacagcaatgtcact

SEQ ID NO: 316967 - DNA, 7613 bp, Homo sapiens
taggagccggaggaggagccgccgccgccgttgacccggccgccggccgggagctgggagagatgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtgagaagcgctatgtggtccaggtgagggaggatgtgactccaggggccccagtactccgagtcacagcctcggatcgagacaaggggagcaatgccgtggtgcactatagcatcatgagtggcaatgctcggggacagttttatctggatgcccagactggagctctggatgtggtgagccctcttgactatgagacgaccaaggagtacaccctacgggtgcgagcacaggatggtggccgtcccccactctctaatgtctctggcttggtgacagtacaggtcctggatatcaacgacaatgcccccatcttcgtcagcacccctttccaggctactgtcctggagagcgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactacgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtcttccagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcctggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccagagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgtgaagtcgtcttccgcaatgagagccacgtcagctgccagtgcaaccacatgacgagcttcgctgtgcttctccccctgtcttctcccctcagcaattcctgcaaagggttaaaaatttaactggtttttactactgatgacttgatttaaaaaaaatacaaagatgctggatgctaacttgatactaaccatcagattgtacagtttggttgttgctgtaaatatggtagcgttttgttgttgttgttttttcatgccccatactactgaataaactagttctgtgcgggtacagcaatgtcact

SEQ ID NO: 316968 - DNA, 591 bp, Homo sapiens
aggaaggttatggtaacataaaataacaacttggtgacgtgtaactctgcataggatatatttcttttttttgaggcagagtcaaattggaggccccaaatgtacacaatactttttttgggtggctaaataactaatctgccttggcactaaaatatgtatctgaaataatttcaccaagttttaaaaagaaaaattataaaaagtatactttcattttaagttatattcgattttagtctccccctaccccctagaaaaaaacctgcacatctcacacacggagctgaaacttttgaggacttgtgtgtgtctgggagtgggtgagaggctgatgggagcaagatgcgcgcatctccccctgtcttctcccctcagcaattcctgcaaagggttaaaaatttaactggtttttactactgatgacttgatttaaaaaaaatacaaagatgctggatgctaacttgatactaaccatcagattgtacagtttggttgttgctgtaaatatggtagcgttttgttgttgttgttttttcatgccccatactactgaataaactagttctgtgcgggtacagcaatgtcact

SEQ ID NO: 316969 - DNA, 312 bp, Homo sapiens
gcctagggagggctggggagcctgggcaggacagcagagggagagctgctcctgggtgaccatgtgctcttccccgcagtgaattatgacagctgcccacgagcgattgaggctgggatctggtggccccgtacccgcttcgggctgcctgctgctgctccctgtcccaaaggctcctttggtaggtgttggaggccccgatgtgatgtcgaggacatggcctctgctgttagtgggatgagggcaggaagctcctggctgaagatccggggaccccactttctggcctccaggtcctgggatttcatttcc

SEQ ID NO: 316970 - DNA, 440 bp, Homo sapiens
gtgagtggggcacccccagctgccgagctcccctagtcagcagcctcatacctcacattctcctgtggccgcacctcacagccccgccccggcccacaggcatccttaagaagaagtgtctgcccaccatcagcgagaagagcagcctcctgcggctccccctggagcaatgcacagggtcttcccggggctcctccgctagtgagggcagccggggcggcccccctccccgcccaccgccccggcagagcctccaggagcagctgaacggggtcatgcccatcgccatgagcatcaaggcaggcacggtggatgaggactcgtcaggctccgagtgagtgtggccgggtgggcgggacggggtgcagcccctcggaggcctcacctgggcccagagctgcctccgggcctccccaggtgactctggatggcatttggag

SEQ ID NO: 316971 - DNA, 10550 bp, Homo sapiens
taggagccggaggaggagccgccgccgccgttgacccggccgccggccgggagctgggagagatgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtgagaagcgctatgtggtccaggtgagggaggatgtgactccaggggccccagtactccgagtcacagcctcggatcgagacaaggggagcaatgccgtggtgcactatagcatcatgagtggcaatgctcggggacagttttatctggatgcccagactggagctctggatgtggtgagccctcttgactatgagacgaccaaggagtacaccctacgggtgcgagcacaggatggtggccgtcccccactctctaatgtctctggcttggtgacagtacaggtcctggatatcaacgacaatgcccccatcttcgtcagcacccctttccaggctactgtcctggagagcgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactacgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtcttccagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcctggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccagagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggcggcccccctccccgcccaccgccccggcagagcctccaggagcagctgaacggggtcatgcccatcgccatgagcatcaaggcaggcacggtggatgaggactcgtcaggctccgaatttctcttctttaacttcctgcattaaccctgggccgtggttcctacgcccgaggctcccttcccttccccagccgcactcatgccctgctcctgtcttgtgctttatcctgccccgctccccatcgcctgcccgcagcagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgtctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgcgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctccccctgtcttctcccctcagcaattcctgcaaagggttaaaaatttaactggtttttactactgatgacttgatttaaaaaaaatacaaagatgctggatgctaacttgatactaaccatcagattgtacagtttggttgttgctgtaaatatggtagcgttttgttgttgttgttttttcatgccccatactactgaataaactagttctgtgcgggtacagcaatgtcact

SEQ ID NO: 316972 - DNA, 7686 bp, Homo sapiens
gctgggggcatccccttgtccactgcatatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtcttccagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcctggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccagagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggcggcccccctccccgcccaccgccccggcagagcctccaggagcagctgaacggggtcatgcccatcgccatgagcatcaaggcaggcacggtggatgaggactcgtcaggctccgacagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgtctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgcgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctccccctgtcttctcccctcagcaattcctgcaaagggttaaaaatttaactggtttttactactgatgacttgatttaaaaaaaatacaaagatgctggatgctaacttgatactaaccatcagattgtacagtttggttgttgctgtaaatatggtagcgttttgttgttgttgttttttcatgccccatactactgaataaactagttctgtgcgggtacagcaatgtcact

SEQ ID NO: 316973 - DNA, 9110 bp, Homo sapiens
taggagccggaggaggagccgccgccgccgttgacccggccgccggccgggagctgggagagatgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtgagaagcgctatgtggtccaggtgagggaggatgtgactccaggggccccagtactccgagtcacagcctcggatcgagacaaggggagcaatgccgtggtgcactatagcatcatgagtggcaatgctcggggacagttttatctggatgcccagactggagctctggatgtggtgagccctcttgactatgagacgaccaaggagtacaccctacgggtgcgagcacaggatggtggccgtcccccactctctaatgtctctggcttggtgacagtacaggtcctggatatcaacgacaatgcccccatcttcgtcagcacccctttccaggctactgtcctggagagcgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactacgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtcttccagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcctggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccagagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctccctgtaagatgctcctactgcccagaaactgtccccaccttctcaggccgcctccccagcccccactggcaacccctgctcctgcaccatgaactctaataaggtgcctagtgcagcacctggcccagggtttcctcttctgtggctcccccgggatcccccagcacctgccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgtctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgcgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctccccctgtcttctcccctcagcaattcctgcaaagggttaaaaatttaactggtttttactactgatgacttgatttaaaaaaaatacaaagatgctggatgctaacttgatactaaccatcagattgtacagtttggttgttgctgtaaatatggtagcgttttgttgttgttgttttttcatgccccatactactgaataaactagttctgtgcgggtacagcaatgtcact

SEQ ID NO: 316974 - DNA, 549 bp, Homo sapiens
cacggcatccgacgtaacctgacagctgccctgggcctggctcagctggtcttcctcctgggaatcaaccaggctgacctccctgtaagatgctcctactgcccagaaactgtccccaccttctcaggccgcctccccagcccccactggcaacccctgctcctgcaccatgaactctaataaggtgcctagtgcagcacctggcccagggtttcctcttctgtggctcccccgggatcccccagcacctgcctctggcccaggcttccctggaagcagttcccaacacccaggccctcctccatgcctgacccgaagcagagcctgtgctctgggcgggccccggtcgctgacctgccctggcctgggccctcagtttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcac

SEQ ID NO: 316975 - DNA, 810 bp, Homo sapiens
cggctgtacgggccggaattatgggatctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctgggcttgtaaaaccctcagcagacgtgcaaacagggattctctata

SEQ ID NO: 316976 - DNA, 607 bp, Homo sapiens
tgcccgcagttcccgcctcctcaggtccgggcgggtccctggccggggtagcacggaagggtctcccaggcggcgtagtagggcttccgtgttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcagaactgaataggactcgcaacttcatagacggttgtgaagacaagctagacggcagatgaaagttcttggcacagagtgaacacttgataaactatatggcagggagggctggaacggggcttgtttgaagagcaatatgagccagggttatagacctgagtttggggtaagagtggaacatccaaatggaagagtccagcagctgaaagga

SEQ ID NO: 316977 - DNA, 449 bp, Homo sapiens
ctgcatggcctagtcctggtagtgggatggtctgaagctcccccttcttttcccacagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcataggtgagctgcccgctgcatcctccaccactcctggttaatttttatttttatagaggcgggtctctctatatacctggcgaccat

SEQ ID NO: 316978 - DNA, 351 bp, Homo sapiens
agtatcttgtctggacagtgcatttgaccagtttgaagttcttcccaggattgaagctgttgctatagaagcagaccttgaggatacgcacgtcctccttttccacatctactggtacccccacccatgcccagccgacctaagtacagaccccctccgcaaaccaacctcctggctccaaagctgcagttccaggttcctgagggtctgtgtgccagctctcctacgctcaccagccctatggagtatccatctcccgttaactcactgcacacgacacatcttcaactggacactagccaaccagctggctactaaatgagcgaggctacgctaccactgactgctagc

SEQ ID NO: 316979 - DNA, 291 bp, Homo sapiens
tgcaagcctgatgcttgacctttctccccaccagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcaggatgatcaggacagcaggatgatcaggac

SEQ ID NO: 316980 - DNA, 187 bp, Homo sapiens
ttggggtctggacttctctcctgcctgagccactggtagtcctccaccatctgcttctgctgtttgtccaggatttgcccagccgacctaagtacagaccccctccgcaaaccaacctcctggctccaaagctgcagttccaggtaaagatagaaccagaggacgggaacttcaggtctacctctca

SEQ ID NO: 316981 - DNA, 4204 bp, Homo sapiens
aaccacaagtcaaatagaaagaagttaaaagaatgtttatgcaaacacatgagaaaagaagggtgcagatgagaataggggtgtggttaacaactcagaggaggagggagaatctaacctgtcagcccttttactcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggaccgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcgcagcagaacgccgtgacctccctgagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggagaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 316982 - DNA, 4018 bp, Homo sapiens
cggtacaggtaagtcggccgggcaggtaggggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggaccgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcgcagcagaacgccgtgacctccctgagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggagaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 316983 - DNA, 4564 bp, Homo sapiens
tgcccgcagttcccgcctcctcaggtccgggcgggtccctggccggggtagcacggaagggtctcccaggcggcgtagtagggcttccgtgttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcagaactgaataggactcgcaacttcatagacggttgtgaagacaagctagacggcagatgaaagttcttggcacagagtgaacacttgataaactatatggcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggaccgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcgcagcagaacgccgtgacctccctgagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggagaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 316984 - DNA, 4113 bp, Homo sapiens
  misc_feature (4057)..(4057): n is a, c, g, or t
  misc_feature (4068)..(4068): n is a, c, g, or t
  misc_feature (4073)..(4073): n is a, c, g, or t
  misc_feature (4076)..(4076): n is a, c, g, or t
  misc_feature (4080)..(4080): n is a, c, g, or t
  misc_feature (4095)..(4095): n is a, c, g, or t
  misc_feature (4097)..(4097): n is a, c, g, or t
  misc_feature (4100)..(4101): n is a, c, g, or t
cggtacaggtaagtcggccgggcaggtaggggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggaccgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcgcagcagaacgccgtgacctccctgagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggagaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttgaaaaaaaaaaaaaaaaaaaaaaaaaaaaaaaaaaactgngggggaatatntttgnggngggnggagaaaaagagagngnaannagaagaggggcc

SEQ ID NO: 316985 - DNA, 4074 bp, Homo sapiens
tttgagacttgtcactccctgagatccatcgtggcaccaaatgtttgccgagctccgccctgggagggaggcctgcagcctgggaactgggagacctgggtcccagtggagaggcctcaccatgtagactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggaccgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcgcagcagaacgccgtgacctccctgagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggagaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 316986 - DNA, 3010 bp, Homo sapiens
gctagacttagacagtggcaaacctgagatgccttggatttgaaactgagatttttttttctctccctatactgattgccttttgtgtgcccatggagctgtgcggggattctagtaacgtggacctgggacctagccttcagagggagcagggtgatggctcttccctgggtctgagacagtggaacattctagacccccatttccccagcccagtccctggatcttggctgaggtgttatagatctggtgacgcctggctttagagcctgcagacactcaggttccctaggggataccaccgatctctgtgatctgcgactgttttctctgtctgtgcaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggaccgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcgcagcagaacgccgtgacctccctgagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggagaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 316987 - DNA, 1760 bp, Homo sapiens
gctggaactgcagctttggagccaggaggttggtttgcggagggggtctgtacttaggtccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggaccgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcgcagcagaacgccgtgacctccctgagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggagaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 316988 - DNA, 2033 bp, Homo sapiens
taaccacatcagtcagtctgtaatgcaactgaaacaactattttttgaagagtcctgaaggaagagccctggtctcagtgggtccgtaaccagcatggaccccactgtgtgcagagcatcttgggggaatgttggatgaatgagaggctgcgctgctccaccatctctctcggagcaatggaaggcccacgttttgttctttattaactcctggagagcaagccccattccctgtggtgctcatgcatagtttctttgtgctcgtgtttgtagcagctaattgtctaccttctcgctttgtcccgtgccttgtgcttctttgcttttcctgaataggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggaccgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcgcagcagaacgccgtgacctccctgagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggagaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 316989 - DNA, 1629 bp, Homo sapiens
agagctggggcaccactgcaatccccccatcttgctgggactttgcctttttcttcctataaaagggacaacagtgctgtccctgactactgcaaaaccagggagaccaggaggttccttcccctgcccgcttcctggattcagagttaatttccctgaagtctcctggtggtagaggggaaggggctcatttgatgtcagcaggtacgaagggaagggttggagtgctgagaactgccccccacttgctgttctttttattgcagtggagttcacagggcccccacagaagcccccgaggctgggcgcacagtccatccagcccacagctaacctggaccggaccgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcgcagcagaacgccgtgacctccctgagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggagaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 316990 - DNA, 1447 bp, Homo sapiens
gagtatctaagatcccggaggaggtctcgtcctggaacccatgtgtttatatgaatgatacgtcccattgacgcagagaagaagtccgtaattgagttaagggcccaaagaagcccgaggtgggggcacagtccatccagcccacagctaacctggaccggaccgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcgcagcagaacgccgtgacctccctgagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggagaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 316991 - DNA, 1158 bp, Homo sapiens
gggctaggtacgaggcctgggtgttgatcctgccttcctgccgtcatcttcacggacagagatcgagggcacccagaaactgctcaacaaagacctggcagagctcatcaacaagatgcggctggcgcagcagaacgccgtgacctccctgagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggagaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 316992 - DNA, 3543 bp, Homo sapiens
tgcccgcagttcccgcctcctcaggtccgggcgggtccctggccggggtagcacggaagggtctcccaggcggcgtagtagggcttccgtgttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcagaactgaataggactcgcaacttcatagacggttgtgaagacaagctagacggcagatgaaagttcttggcacagagtgaacacttgataaactatatggcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctaccgtgagtgttcccgcccttcttcggggggtttcctcttggcaccttgtgcagagccaccatccttgcccaccgcccagggcagggagcagcggagtctgtctgcattccctgcagcatcggccatgatttaattcagagcatgtggggcaggccagcttcccctccgctccctccaccccattcctctccctgcctagcaccctgcccttctctctctcagtggccacatccttaggcccctcctcagatcatccccctcctgcattagtttggaggagctggaaattctctcttcctcatttcctgctctgttggaagctcccgtgggaaaagttaagcagt

SEQ ID NO: 316993 - DNA, 2408 bp, Homo sapiens
tgcccgcagttcccgcctcctcaggtccgggcgggtccctggccggggtagcacggaagggtctcccaggcggcgtagtagggcttccgtgttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcagaactgaataggactcgcaacttcatagacggttgtgaagacaagctagacggcagatgaaagttcttggcacagagtgaacacttgataaactatatggcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacaggtaggggtggagggagtggccagcggtatggaagccaggccttcaccagatcctcaaggcctctgggtagaagcagggcttgtgggtgacacagagcagtgttggaatccca

SEQ ID NO: 316994 - DNA, 2335 bp, Homo sapiens
  misc_feature (1913)..(1913): n is a, c, g, or t
  misc_feature (1919)..(1919): n is a, c, g, or t
tgcccgcagttcccgcctcctcaggtccgggcgggtccctggccggggtagcacggaagggtctcccaggcggcgtagtagggcttccgtgttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcagaactgaataggactcgcaacttcatagacggttgtgaagacaagctagacggcagatgaaagttcttggcacagagtgaacacttgataaactatatggcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatgcattncccgtnaagatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactcgtgccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagca

SEQ ID NO: 316995 - DNA, 1328 bp, Homo sapiens
tgcccgcagttcccgcctcctcaggtccgggcgggtccctggccggggtagcacggaagggtctcccaggcggcgtagtagggcttccgtgttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcagaactgaataggactcgcaacttcatagacggttgtgaagacaagctagacggcagatgaaagttcttggcacagagtgaacacttgataaactatatggcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctgggcttgtaaaaccctcagcagacgtgcaaacagggattctctata

SEQ ID NO: 316996 - DNA, 905 bp, Homo sapiens
aaccacaagtcaaatagaaagaagttaaaagaatgtttatgcaaacacatgagaaaagaagggtgcagatgagaataggggtgtggttaacaactcagaggaggagggagaatctaacctgtcagcccttttactcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggcaaaatgccacctgcttattgcaaatagctgagggtttaaagccacttagacttctagccaagtcctgctccatccttactggttgtgtggcctgggacctaatgattaactgatctgggcttcagtctcttcacccggggatcatgctgtaaggattggagatggtggaggagaagcacaaagcacacagcagtgcccataactggaggctattgactgtgtgggtattaggttattacccagctcaggaatctccaagggcctctaattgcccagagaataaagtgcaaattgtcttcttttggtgtctatccaggtatctgtcttattttcaaataaagaagtaatatgatcagatttgtgttctaaaacaacaacatggtgttctgcaagatgttaagaagtg

SEQ ID NO: 316997 - DNA, 302 bp, Homo sapiens
aaaaagcaattcaaacctaattcttctctttcttcctcctctccacaccatactcgtctcttctcttgtgagacgagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 316998 - DNA, 399 bp, Homo sapiens
gcagctgtgggaggctgaaaaggtcaaaatgcggcaaatcctggacaaacagcagaagcagatggtggaggactaccagtggctcaggcaggaggagaagtccctggtgagcaccccaggaaggatgtcggtgccctgcacccatctgtgtcctcttccacctccccaggtggctggggcaagggtcccctgcattcttggtgctttcagctccagaattcttagtccttcgctcttgtttcttcctctgcaggaccccatggtttatatgaatgataagtccccattggtgagttgccaggagaggccgcctcctccatgccaaggcctgggaaggcctcgcccaccataggaccccccgcccaacttgctcctacccccaggcctgcccagctcctc

SEQ ID NO: 316999 - DNA, 512 bp, Homo sapiens
atatttttaagcaggggcaagatattcctggagttgtatgatataccctgctgggtgtttaagggatgaaagtaacacaacaggcctatggagaaggcaatgagacccaggcttaagaagaatggctttgaggcattatctggggtcggtggggaacagaggtggagaacagaagtgactgacttccaggaatatgtccaagccttctgatttttcctgcttccaatgtctcctgcaggcaaaatgccacctgcttattgcaaatagctgagggtttaaagccacttagacttctagccaagtcctgctccatccttactggttgtgtggcctgggacctaatgattaactgatctgggcttcagtctcttcacccggggatcatgctgtaaggattggagatggtggaggagaagcacaaagcacacagcagtgcccataactggaggctattgactgtgtgggtattaggttattacccagctcaggaatctccaagggcctctaattgc

SEQ ID NO: 317000 - DNA, 749 bp, Homo sapiens
gccaagctggatctataaggaattgcatatgagatggcacacatattcatgctgtctgaagattcagtcacgttaccatatcaagctgaaaatgtcaccactatctggagagttggacatgttttattgagaatgtattttttttctctggatctgttatgaacacctttgttggcttggttcagtaataaatatgtgagacttttcatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaccccataaaccaaaaaaaatcttaaaaacccggggggccttttttggcccccgcatttttaacctacttgccctttttccccgtaccgaattcgggctaatttggccagtccccccttttaaggggttcttaaaggaaaaacgcggggggtttcaaaattagtggcttgggaaaaacctcggttttcccaattttgcgcttttggaaaaaaacccctttttgagcgctgtttcaaaaagggggagccctcaaagtgaacggttttccaagaagggccacacctttggggcacacgcggatacatgcggcaaaaattctgtaaattttcgccatagctttggtataaccaaatcttttattaccaaagggcgcaacccgtaaaatctcttttttctccacaatttctccctaatacgtttttttgttcctccctctttc

SEQ ID NO: 317001 - DNA, 1353 bp, Homo sapiens
gccaagctggatctataaggaattgcatatgagatggcacacatattcatgctgtctgaagattcagtcacgttaccatatcaagctgaaaatgtcaccactatctggagagttggacatgttttattgagaatgtattttttttctctggatctgttatgaacacctttgttggcttggttcagtaataaatatgtgagacttttcatttaaaaaaagtcaaatgacttaattctgtattttaaattctgttttgtttgttttgtttttttgagatggagtcttctgaaaattttctcatcttctctaacccggttcatgacagacccttggactttactgttgtggaaaaatctatataaaacagtatcagtgtgtcaaagcattatggctgtcacaagcttgtgaaaggaaaataaaaattactaagccaaagagaaaagtcaatctgggaactgcgtcagacaaacctgccttccattttattcctaaacaagatagttacaaagattttttaaaaagctacatatgcccctcccaaaccgggaacctcaagatctccaccctaaaatagttctgttgaatttcaccctggcgatgtaaactgagagcttatcttcacagatgtgggaaagagcccatccctctgcacacctgagtcaaatgtctatctgattgcttcccttgccctatttatgtaaaaatacagggtccctgagccagcctaaggcataagtgacttatccctcctccctgctcacatataaattgtgtatttagtgaaaggctgatcaaagattcaaagaatgttatttgttatctacctgtgacccagaagttccccaattccagttattccacctttccagaccggaccaatgtatatatgtactgattgctgtctcgtgtgtctgtaaaatgtgtgaaaccaaactgcagcctcaacaccatggacacacgtcatcaggacctcctgaggttcgtgttaattggccttagactctccctgtccccagacccaggacgcatgtgtttcctttttcttcatttctattaaagatgggtctcattctgttggccaggcatgagagcggtgacaggatcagccctcactgaagcttcaatctcctgggttcaagggatcctcccacctcagcctccaaagttgctaggaccatagccaggtgccaccgcaccgggcaaatttttgtgttcctagtagagatgggctttcaccatgttgcccgagctggtcttgaattccagggctcaagcgatccagccgtattggcctcccaaggtgctgggattacagccatgagccaccatgaccaacgtgtttcttaatttaaa

SEQ ID NO: 317002 - DNA, 687 bp, Homo sapiens
  misc_feature (58)..(59): n is a, c, g, or t
  misc_feature (62)..(62): n is a, c, g, or t
  misc_feature (67)..(67): n is a, c, g, or t
  misc_feature (72)..(72): n is a, c, g, or t
  misc_feature (75)..(75): n is a, c, g, or t
  misc_feature (651)..(651): n is a, c, g, or t
  misc_feature (657)..(657): n is a, c, g, or t
tgtcctaccactaatttaatcgatggaaaggagagttctagtctgaacgactctcttnnttnaccancgctncangatgagatgaacacttttaacaagagaacaggactctatataaatcgctgtgggctcaccacctctaaggaggagcactgactgaagacagaaaaattgatgaactgaagaagacatggtccattatgccttacaaacttacacagtgctttgggaattccaaagtactcagtggagagaggtgtttcaggagccgtagagccagatcgtcatcatgtctgcattgtggctgctgctgggcctccttgccctgatggacttgtctgaaagcagcaactggggatgctatggaaacatccaaagcctggacacccctggagcatcttgtgggattggaagacgtcacggcctgaactactgtggagttcgtgcttctgaaaggctggctgaaatagacatgccatacctcctgaaatatcaacccatgatgcaaaccattggccaaaagtactgcatggatcctgccgtgatcgctggtgtcttgtccaggaagtctcccggtgacaaaattctggtcaacatgggcgataggactagcatggtgcaggaccctggctctcaagctggaggagaaanccaccnttcaaaccaaaaaaaaaaggttttcccgta

SEQ ID NO: 317003 - DNA, 996 bp, Homo sapiens
ataatttatgagatgtcataaatctctccaaaataggatgagatgaacacttttaacaagagaacaggactctatataaatcgctgtgggctcaccacctctaaggaggagcactgactgaagacagaaaaattgatgaactgaagaagacatggtccattatgccttacaaacttacacagtgctttgggaattccaaagtactcagtggagagaggtgtttcaggagccgtagagccagatcgtcatcatgtctgcattgtggctgctgctgggcctccttgccctgatggacttgtctgaaagcagcaactggggatgctatggaaacatccaaagcctggacacccctggagcatcttgtgggattggaagacgtcacggcctgaactactgtggagttcgtgcttctgaaaggctggctgaaatagacatgccatacctcctgaaatatcaacccatgatgcaaaccattggccaaaagtactgcatggatcctgccgtgatcgctggtgtcttgtccaggaagtctcccggtgacaaaattctggtcaacatgggcgataggactagcatggtgcaggaccctggctctcaagctcccacatcctggattagtgagtctcaggtttcccagacaactgaagttctgactactagaatcaaagaaatccagaggaggtttccaacctggacccctgaccagtacctgagaggtggactctgtgcctacagtgggggtgctggctatgtccgaagcagccaggacctgagctgtgacttctgcaatgatgtccttgcacgagccaagtacctcaagagacatggcttctaacatctcagatgaaacccaagaccatgatcacatatgcagcctcaaatgttacacagataaaactagccaagggcacctgtaactgggaatctgagtttgacctaaaagtcattaaaataacatgaatcacattaaaggaagaattttgacctgcaaaataa

SEQ ID NO: 317004 - DNA, 1035 bp, Homo sapiens
  misc_feature (58)..(59): n is a, c, g, or t
  misc_feature (62)..(62): n is a, c, g, or t
  misc_feature (67)..(67): n is a, c, g, or t
  misc_feature (72)..(72): n is a, c, g, or t
  misc_feature (75)..(75): n is a, c, g, or t
tgtcctaccactaatttaatcgatggaaaggagagttctagtctgaacgactctcttnnttnaccancgctncangatgagatgaacacttttaacaagagaacaggactctatataaatcgctgtgggctcaccacctctaaggaggagcactgactgaagacagaaaaattgatgaactgaagaagacatggtccattatgccttacaaacttacacagtgctttgggaattccaaagtactcagtggagagaggtgtttcaggagccgtagagccagatcgtcatcatgtctgcattgtggctgctgctgggcctccttgccctgatggacttgtctgaaagcagcaactggggatgctatggaaacatccaaagcctggacacccctggagcatcttgtgggattggaagacgtcacggcctgaactactgtggagttcgtgcttctgaaaggctggctgaaatagacatgccatacctcctgaaatatcaacccatgatgcaaaccattggccaaaagtactgcatggatcctgccgtgatcgctggtgtcttgtccaggaagtctcccggtgacaaaattctggtcaacatgggcgataggactagcatggtgcaggaccctggctctcaagctcccacatcctggattagtgagtctcaggtttcccagacaactgaagttctgactactagaatcaaagaaatccagaggaggtttccaacctggacccctgaccagtacctgagaggtggactctgtgcctacagtgggggtgctggctatgtccgaagcagccaggacctgagctgtgacttctgcaatgatgtccttgcacgagccaagtacctcaagagacatggcttctaacatctcagatgaaacccaagaccatgatcacatatgcagcctcaaatgttacacagataaaactagccaagggcacctgtaactgggaatctgagtttgacctaaaagtcattaaaataacatgaatcacattaaaggaagaattttgacctgcaaaataa

SEQ ID NO: 317005 - DNA, 615 bp, Homo sapiens
acacagtgctttgggaattccaaagtactcagtggagagagggtgagtagaggaagatgtccccatcaaagccaccaggaacatgaggtagctcctgagggatgctctggttgtcagtttccagtgtgcctggcaggcctgttgccccagcttgttgacacccccttgctgtttgttactattttgctctctgggaagggagaagagggatgctaccataaacattgtgcttgacatcatgaccactgtgctgccttggtctgacatcttcataatggttttaagcagggagccacaggggaattaacaaatgagtcatagggaactgacagacactctttgagcacacccgagtgatgtctcaacaatctcttctaaacacagagtacttttcgtcacttgtaaagttgggccatagagtttgggttgcttcaatatgctgtatttatggacaaaatgacattgttcatccatttaagaattccaagctaggtgtggtggcttgagcctgtaaccctacctactcaggaagctgaggtggaaggatcacttgaagcctggagttcaagaccagcctgggcaacatagtgagacccatttctacataaaaactaa

SEQ ID NO: 317006 - DNA, 2080 bp, Homo sapiens
tcctgagtagctgggattatgggtgtgtgccaccatgcttggctaatttttctatttttagtagagatggggtttcaccaagttggccaggctaatcttgaactcttgacctcaggtgatctgcctgcctcggcctcccaaagtgttgggattacaggcatgagccgccacaccctgccaaaagacccatctttcaatactgccacatttgggattaagtttcaacatgaagtttggagaggacaaacatcatcatagtgggagatctaaatacacctttctaaggaactgatgaatgaaggaaacatagaagtctataaagacatagaaaatttaccaacaagcttacttaatgaccatatataatataattgtgaaatacagattcttttcaactgcacacatggaatatttatgagagtcttaaagcaagccaacaaattttagattagtaacgtagaaataatcttctttaaccgtaaagcaattaattcaggaatcaatagcgagagataaccagaaaaaccctatactttcaggaattttagaatatactgctagatacattatgagtcaaaaaaagaaaactaatgggagttagataatatttagagctgaatgataacaaaaatactagataccaatatttggaccatgcagctaaaggggtgcttagaaaaaattttgtagcataaatccttacattaagaaaggaaaaggtgacttggcatggtggcttatgcctgtaatcccagcactttgcaaggctgaggtgggaggatcgcttgaggctaggaattcaatactagcctggagaaaagaaaagaaaaagagaaagaaagcaaaagaagaagagaaaaagaaagaaaggaaggagaggtgcaagttaaggagttaattatccaatttaagaagacagaaaaaggggaagacaatacaaagatatgagcaaaaataaatgaagaaaaacaagcatataaaagagagaaggcacagcaaatgatttaggagtaaaaaagagaccacaactatagatgctgcagagattaaaccagcaaaaacaaatattgataaataattataaaaaattggaaaattttgatggaattgatatattccaagaaaaatgtcatcaaaattgaaccaagaaaatatttaaaaatctaagcagtcctttgctcattaaaggataaatcagtagttaacactttttctacaaagaaatggtgtgcctggatggtcgtgtaggtgagttttaccaaggattatggtaacaaatgagtgagacctctatggagaaaatattgaaggacattaaagaagacctcataaatggagagagatatatcattaatggataggaagcctcaatggcataagtatgtcagtttctttcaaaactcacctatggattcaatgtgattccaaaccaaatcccaacaaggtctttcctggaattggaagccagattctgaaatgtatttggaaaagtaaagaggcagggttagctatttcattaacaaagaaggaacatcaggcagggagacttgtgttattattaaggcttattataaattattattgtgatcaagatagtgtatttttggtgtagagatagttaaattggccaatggattgagccaaatttccaaaacagacccacaaataaatgaaactctaatttacaacagagacagtactgcagatcatggggggaaaggatgaactattgagggattggcaaacttttttggtaagggctagacagccttacgtggtgttcacagtgtctgttgtagttagtcacctctgctgtggtattgtaagagcagctatagacaatactgtacgtgaacaaatgatcatggatatgttctaataaaactttatgtgcattgagatttaaatttcatataattttcatgggtcatgagttattagctttctttttgtttttctcagccatttaaaatgcagaaaccattattagctactgggctgtacaaaaacgggcaaaggagaccaggcatggtggttcacacctataatcccaacactttgggaggcagaggcaggagga

SEQ ID NO: 317007 - DNA, 1983 bp, Homo sapiens
aatataaataaaatcggtacagtggtgtctgcctgtactcccaaagtgttgggattacaggcatgagccgccacaccctgccaaaagacccatctttcaatactgccacatttgggattaagtttcaacatgaagtttggagaggacaaacatcatcatagtgggagatctaaatacacctttctaaggaactgatgaatgaaggaaacatagaagtctataaagacatagaaaatttaccaacaagcttacttaatgaccatatataatataattgtgaaatacagattcttttcaactgcacacatggaatatttatgagagtcttaaagcaagccaacaaattttagattagtaacgtagaaataatcttctttaaccgtaaagcaattaattcaggaatcaatagcgagagataaccagaaaaaccctatactttcaggaattttagaatatactgctagatacattatgagtcaaaaaaagaaaactaatgggagttagataatatttagagctgaatgataacaaaaatactagataccaatatttggaccatgcagctaaaggggtgcttagaaaaaattttgtagcataaatccttacattaagaaaggaaaaggtgacttggcatggtggcttatgcctgtaatcccagcactttgcaaggctgaggtgggaggatcgcttgaggctaggaattcaatactagcctggagaaaagaaaagaaaaagagaaagaaagcaaaagaagaagagaaaaagaaagaaaggaaggagaggtgcaagttaaggagttaattatccaatttaagaagacagaaaaaggggaagacaatacaaagatatgagcaaaaataaatgaagaaaaacaagcatataaaagagagaaggcacagcaaatgatttaggagtaaaaaagagaccacaactatagatgctgcagagattaaaccagcaaaaacaaatattgataaataattataaaaaattggaaaattttgatggaattgatatattccaagaaaaatgtcatcaaaattgaaccaagaaaatatttaaaaatctaagcagtcctttgctcattaaaggataaatcagtagttaacactttttctacaaagaaatggtgtgcctggatggtcgtgtaggtgagttttaccaaggattatggtaacaaatgagtgagacctctatggagaaaatattgaaggacattaaagaagacctcataaatggagagagatatatcattaatggataggaagcctcaatggcataagtatgtcagtttctttcaaaactcacctatggattcaatgtgattccaaaccaaatcccaacaaggtctttcctggaattggaagccagattctgaaatgtatttggaaaagtaaagaggcagggttagctatttcattaacaaagaaggaacatcaggcagggagacttgtgttattattaaggcttattataaattattattgtgatcaagatagtgtatttttggtgtagagatagttaaattggccaatggattgagccaaatttccaaaacagacccacaaataaatgaaactctaatttacaacagagacagtactgcagatcatggggggaaaggatgaactattgagggattggcaaacttttttggtaagggctagacagccttacgtggtgttcacagtgtctgttgtagttagtcacctctgctgtggtattgtaagagcagctatagacaatactgtacgtgaacaaatgatcatggatatgttctaataaaactttatgtgcattgagatttaaatttcatataattttcatgggtcatgagttattagctttctttttgtttttctcagccatttaaaatgcagaaaccattattagctactgggctgtacaaaaacgggcaaaggagaccaggcatggtggttcacacctataatcccaacactttgggaggcagaggcaggagga

SEQ ID NO: 317008 - DNA, 883 bp, Homo sapiens
agaccagcactgcgatatcctgaacgtttgaagaaattacataacctgaagacagaaggttacaggaaacagcagcagcggcagcagcagcagcagcagcaacagaagaaggtgaaaacacctattaagaaacaggaggctaaaaagaaagccaagagtgatccagggatccagagcacttcacataaacatccagttaccaccgttcatgaccgtctctatggttacagaactctgccaggtcagaacagtgacatgaagcagcagcagcagatggaaaaaggaaccacttcgaaacaggattccacggagagaccaaagatgaactactatgaccatgcggatttccaccacagtgtaaaaagtcctgaattgtatgaaacagaacccactaacaaggacattagtgctccagtggacgctgtgccagaagcccaggctgccaggcaaaagaagatctcctttaacttttcagaaattatggctagcacaggctggaactctgagctcaaactacttaggattcttcaggacactgatgatgaggatgaggaggaccagtcctctggggcagagtgagaagcctctggaggaatagactgaaggcatcccctggggcagccgtgttccaaagcgggatggctggtatcctgagggcagcaacgtttcacataagggcaagaggagaggggcttctgctctctggagcctttaccagggcctgagctctgagcttagggattccattttctttgttcacctctacttgcctctaaaataaatgtaggagaaaaatccccagcctttttaaatttagattatttcctttccattagggtcagaataattttggtgattaaacacaactgcttttcaaaaaaaa

SEQ ID NO: 317009 - DNA, 171 bp, Homo sapiens
caatctgtgggttcgtcattgatacacaataacacaaaaaggcacttaagaagcttgcttattttctgtcatttgggtatgtctagcttattttcaagtaactgtgtttcacattaagtgccaacatatttttgttttaagactttgtgttaaccactagtttgacatgaa

SEQ ID NO: 317010 - DNA, 4843 bp, Homo sapiens
ccagagggcgaagtgggagggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaataaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaatctaaatgtattcagttgacaaaatggacacataagggctttttctaaataccgtacataattacacattttcacacttagagggtaatcctatgatacactgtcaatctctattttaaaagactatcaccagaaaagagagaaaagaaaattcatataagaaaaagaaaatgtgaaaaagatcataggcttgggaattccctcaaatccagaaaattccaggttaaggcttgaagttgaatcattcccaggtctagctctaaggttaacaagagtacaaggcaaacaatttctttggggacaagcagcattatttcaattagaccttctcctgcagggcaaaaatcattcttccccacactatgaatggactccaagtatcataataagcaggtaaactcacaagaaccaaagctgacatatggataaaagcagcaagatcacagtacaccaaagtatcatatatatagaagaaataattcaatgtcttagatttgtctataaaaatttgtgatctatataggacttcattcacatggacactaacgataaggagtatttgctttggcggtagtggatcacacatctgcttatcttgctttgatattttttacataatgtttctgagtgatacagatgtgagtcaggtagcatttgatttccccacatatacacaactgaggtgccctgccattggcatcccctgggatccttgattcactgacgttagccatacgaatccagtgttcaaactcagaataataagcttagtttctgcattatcagtcagcataaataataaatccagaaaacgtgctgtatttgttgttgtttcctccatgggctttcccgccatctaatttgatatagacttcatctcccggctccaaatgaagaaccacactgttactggcatagtcgtaattctgatcagcatcttgggcaattgcactagcacgcactgtttttgcagagatcagcccacatgctggtgccgtcccctccgcgcatcaggacgtggtaggtgaagaagtagatgcccgggatggagcaggtgaacttgccggtggtggggtcg

SEQ ID NO: 317011 - DNA, 3757 bp, Homo sapiens
ccagagggcgaagtgggagggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaataaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttc

SEQ ID NO: 317012 - DNA, 4790 bp, Homo sapiens
ccagagggcgaagtgggagggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaataaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaattggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaatctaaatgtattcagttgacaaaatggacacataagggctttttctaaataccgtacataattacacattttcacacttagagggtaatcctatgatacactgtcaatctctattttaaaagactatcaccagaaaagagagaaaagaaaattcatataagaaaaagaaaatgtgaaaaagatcataggcttgggaattccctcaaatccagaaaattccaggttaaggcttgaagttgaatcattcccaggtctagctctaaggttaacaagagtacaaggcaaacaatttctttggggacaagcagcattatttcaattagaccttctcctgcagggcaaaaatcattcttccccacactatgaatggactccaagtatcataataagcaggtaaactcacaagaaccaaagctgacatatggataaaagcagcaagatcacagtacaccaaagtatcatatatatagaagaaataattcaatgtcttagatttgtctataaaaatttgtgatctatataggacttcattcacatggacactaacgataaggagtatttgctttggcggtagtggatcacacatctgcttatcttgctttgatattttttacataatgtttctgagtgatacagatgtgagtcaggtagcatttgatttccccacatatacacaactgaggtgccctgccattggcatcccctgggatccttgattcactgacgttagccatacgaatccagtgttcaaactcagaataataagcttagtttctgcattatcagtcagcataaataataaatccagaaaacgtgctgtatttgttgttgtttcctccatgggctttcccgccatctaatttgatatagacttcatctcccggctccaaatgaagaaccacactgttactggcatagtcgtaattctgatcagcatcttgggcaattgcactagcacgcactgtttttgcagagatcagcccacatgctggtgccgtcccctccgcgcatcaggacgtggtaggtgaagaagtagatgcccgggatggagcaggtgaacttgccggtggtggggtcg

SEQ ID NO: 317013 - DNA, 4764 bp, Homo sapiens
ccagagggcgaagtgggagggcacaggggagactaaaaaggccagggaagttggcctgccggaagttcccagggagaaggcagcgcgttgtacccgagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaataaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaatctaaatgtattcagttgacaaaatggacacataagggctttttctaaataccgtacataattacacattttcacacttagagggtaatcctatgatacactgtcaatctctattttaaaagactatcaccagaaaagagagaaaagaaaattcatataagaaaaagaaaatgtgaaaaagatcataggcttgggaattccctcaaatccagaaaattccaggttaaggcttgaagttgaatcattcccaggtctagctctaaggttaacaagagtacaaggcaaacaatttctttggggacaagcagcattatttcaattagaccttctcctgcagggcaaaaatcattcttccccacactatgaatggactccaagtatcataataagcaggtaaactcacaagaaccaaagctgacatatggataaaagcagcaagatcacagtacaccaaagtatcatatatatagaagaaataattcaatgtcttagatttgtctataaaaatttgtgatctatataggacttcattcacatggacactaacgataaggagtatttgctttggcggtagtggatcacacatctgcttatcttgctttgatattttttacataatgtttctgagtgatacagatgtgagtcaggtagcatttgatttccccacatatacacaactgaggtgccctgccattggcatcccctgggatccttgattcactgacgttagccatacgaatccagtgttcaaactcagaataataagcttagtttctgcattatcagtcagcataaataataaatccagaaaacgtgctgtatttgttgttgtttcctccatgggctttcccgccatctaatttgatatagacttcatctcccggctccaaatgaagaaccacactgttactggcatagtcgtaattctgatcagcatcttgggcaattgcactagcacgcactgtttttgcagagatcagcccacatgctggtgccgtcccctccgcgcatcaggacgtggtaggtgaagaagtagatgcccgggatggagcaggtgaacttgccggtggtggggtcg

SEQ ID NO: 317014 - DNA, 4789 bp, Homo sapiens
ccagagggcgaagtgggagggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaataaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaatctaaatgtattcagttgacaaaatggacacataagggctttttctaaataccgtacataattacacattttcacacttagagggtaatcctatgatacactgtcaatctctattttaaaagactatcaccagaaaagagagaaaagaaaattcatataagaaaaagaaaatgtgaaaaagatcataggcttgggaattccctcaaatccagaaaattccaggttaaggcttgaagttgaatcattcccaggtctagctctaaggttaacaagagtacaaggcaaacaatttctttggggacaagcagcattatttcaattagaccttctcctgcagggcaaaaatcattcttccccacactatgaatggactccaagtatcataataagcaggtaaactcacaagaaccaaagctgacatatggataaaagcagcaagatcacagtacaccaaagtatcatatatatagaagaaataattcaatgtcttagatttgtctataaaaatttgtgatctatataggacttcattcacatggacactaacgataaggagtatttgctttggcggtagtggatcacacatctgcttatcttgctttgatattttttacataatgtttctgagtgatacagatgtgagtcaggtagcatttgatttccccacatatacacaactgaggtgccctgccattggcatcccctgggatccttgattcactgacgttagccatacgaatccagtgttcaaactcagaataataagcttagtttctgcattatcagtcagcataaataataaatccagaaaacgtgctgtatttgttgttgtttcctccatgggctttcccgccatctaatttgatatagacttcatctcccggctccaaatgaagaaccacactgttactggcatagtcgtaattctgatcagcatcttgggcaattgcactagcacgcactgtttttgcagagatcagcccacatgctggtgccgtcccctccgcgcatcaggacgtggtaggtgaagaagtagatgcccgggatggagcaggtgaacttgccggtggtggggtcg

SEQ ID NO: 317015 - DNA, 4418 bp, Homo sapiens
ccagagggcgaagtgggagggcacaggggagactaaaaaggccagggaagttggcctgccggaagttcccagggagaaggcagcgcgttgtacccgagattcagggtctggctctgcttcccaggctagagtgcatttggcgcgatcacagctcactgcagcctcgacctcctgagctcaagcgaacttcctgcctcagcctcctgagcttcctgagtagctgcgactacagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaataaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaatctaaatgtattcagttgacaaaatggacacataagggctttttctaaataccgtacataattacacattttcacacttagagggtaatcctatgatacactgtcaatctctattttaaaagactatcaccagaaaagagagaaaagaaaattcatataagaaaaagaaaatgtgaaaaagatcataggcttgggaattccctcaaatccagaaaattccaggttaaggcttgaagttgaatcattcccaggtctagctctaaggttaacaagagtacaaggcaaacaatttctttggggacaagcagcattatttcaattagaccttctcctgcagggcaaaaatcattcttccccacactatgaatggactccaagtatcataataagcaggtaaactcacaagaaccaaagctgacatatggataaaagcagcaagatcacagtacaccaaagtatcatatatatagaagaaataattcaatgtcttagatttgtctataaaaatttgtgatctatataggacttcattcacatggacactaacgataaggagtatttgctttggcggtagtggatcacacatctgcttatcttgctttgatattttttacataatgtttctgagtgatacagatgtgagtcaggtagcatttgatttccccacatatacacaactgaggtgccctgccattggcatcccctgggatccttgattcactgacgttagccatacgaatccagtgttcaaactcagaataataagcttagtttctgcattatcagtcagcataaataataaatccagaaaacgtgctgtatttgttgttgtttcctccatgggctttcccgccatctaatttgatatagacttcatctcccggctccaaatgaagaaccacactgttactggcatagtcgtaattctgatcagcatcttgggcaattgcactagcacgcactgtttttgcagagatcagcccacatgctggtgccgtcccctccgcgcatcaggacgtggtaggtgaagaagtagatgcccgggatggagcaggtgaacttgccggtggtggggtcg

SEQ ID NO: 317016 - DNA, 4034 bp, Homo sapiens
acttgaggcaccatttcagattatcggataatggcagaagaggaaattcttccaaaacaaggctcagtgtacaacacccgggagaattagggcacaattcctggggaatcaaaaagagacgctctggagagttggccacagcatgggctcatgcatactggcacatatggaccccctatcgggatcacgtgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaataaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaatctaaatgtattcagttgacaaaatggacacataagggctttttctaaataccgtacataattacacattttcacacttagagggtaatcctatgatacactgtcaatctctattttaaaagactatcaccagaaaagagagaaaagaaaattcatataagaaaaagaaaatgtgaaaaagatcataggcttgggaattccctcaaatccagaaaattccaggttaaggcttgaagttgaatcattcccaggtctagctctaaggttaacaagagtacaaggcaaacaatttctttggggacaagcagcattatttcaattagaccttctcctgcagggcaaaaatcattcttccccacactatgaatggactccaagtatcataataagcaggtaaactcacaagaaccaaagctgacatatggataaaagcagcaagatcacagtacaccaaagtatcatatatatagaagaaataattcaatgtcttagatttgtctataaaaatttgtgatctatataggacttcattcacatggacactaacgataaggagtatttgctttggcggtagtggatcacacatctgcttatcttgctttgatattttttacataatgtttctgagtgatacagatgtgagtcaggtagcatttgatttccccacatatacacaactgaggtgccctgccattggcatcccctgggatccttgattcactgacgttagccatacgaatccagtgttcaaactcagaataataagcttagtttctgcattatcagtcagcataaataataaatccagaaaacgtgctgtatttgttgttgtttcctccatgggctttcccgccatctaatttgatatagacttcatctcccggctccaaatgaagaaccacactgttactggcatagtcgtaattctgatcagcatcttgggcaattgcactagcacgcactgtttttgcagagatcagcccacatgctggtgccgtcccctccgcgcatcaggacgtggtaggtgaagaagtagatgcccgggatggagcaggtgaacttgccggtggtggggtcg

SEQ ID NO: 317017 - DNA, 1098 bp, Homo sapiens
ccagagggcgaagtgggagggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggtaagtaggctgtcttacaaatggatgcaaactgccatataattaatgcatgatcaaattaagaatctacagtaatcagtcaatgcaatactaatcacgcagagaaaaccactaactatatggaaggtagtatttataaagtttcacaactgacatgaataaaagtcaatgctgc

SEQ ID NO: 317018 - DNA, 682 bp, Homo sapiens
ccagagggcgaagtgggagggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagaacagcataccttccggtccagcta

SEQ ID NO: 317019 - DNA, 500 bp, Homo sapiens
ggaagttcccagggagaaggcagcgcgttgtacccgaggtaaggcttcttggagtcagagcaggagccggaactgtgggcccagtaggaagagtggggcccgacggcggaggccgcgcggccagggttcgctgcagagctccacgcgagggtcctgccggaaggaaggattttctagccgctgcgcttgggccctgccgcctctccttaagtgcttgagggacgttgcaaagagcgccagtcccgtgtggcgccagctccctgtggctcgacagcaatgcccgggggcgtcatcgggtagctgtgctaagcctcctttaataagcttttttttttttttttttttagattcagggtctggctctgcttcccaggctagagtgcatttggcgcgatcacagctcactgcagcctcgacctcctgagctcaagcgaacttcctgcctcagcctcctgagcttcctgagtagctgcgactacaggcacgtgccaccatgtccg

SEQ ID NO: 317020 - DNA, 2080 bp, Homo sapiens
ccagagggcgaagtgggagggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgca

SEQ ID NO: 317021 - DNA, 4801 bp, Homo sapiens
ccagagggcgaagtgggagggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaataaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaatctaaatgtattcagttgacaaaatggacacataagggctttttctaaataccgtacataattacacattttcacacttagagggtaatcctatgatacactgtcaatctctattttaaaagactatcaccagaaaagagagaaaagaaaattcatataagaaaaagaaaatgtgaaaaagatcataggcttgggaattccctcaaatccagaaaattccaggttaaggcttgaagttgaatcattcccaggtctagctctaaggttaacaagagtacaaggcaaacaatttctttggggacaagcagcattatttcaattagaccttctcctgcagggcaaaaatcattcttccccacactatgaatggactccaagtatcataataagcaggtaaactcacaagaaccaaagctgacatatggataaaagcagcaagatcacagtacaccaaagtatcatatatatagaagaaataattcaatgtcttagatttgtctataaaaatttgtgatctatataggacttcattcacatggacactaacgataaggagtatttgctttggcggtagtggatcacacatctgcttatcttgctttgatattttttacataatgtttctgagtgatacagatgtgagtcaggtagcatttgatttccccacatatacacaactgaggtgccctgccattggcatcccctgggatccttgattcactgacgttagccatacgaatccagtgttcaaactcagaataataagcttagtttctgcattatcagtcagcataaataataaatccagaaaacgtgctgtatttgttgttgtttcctccatgggctttcccgccatctaatttgatatagacttcatctcccggctccaaatgaagaaccacactgttactggcatagtctgtttttgcagagatcagcccacatgctggtgccgtcccctccgcgcatcaggacgtggtaggtgaagaagtagatgcccgggatggagcaggtgaacttgccggtggtggggtcg

SEQ ID NO: 317022 - DNA, 3681 bp, Homo sapiens
ccagagggcgaagtgggagggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaataaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggtta

SEQ ID NO: 317023 - DNA, 4898 bp, Homo sapiens
ccagagggcgaagtgggagggcacaggggagactaaaaaggccagggaagttggcctgccggaagttcccagggagaaggcagcgcgttgtacccgagattcagggtctggctctgcttcccaggctagagtgcatttggcgcgatcacagctcactgcagcctcgacctcctgagctcaagcgaacttcctgcctcagcctcctgagcttcctgagtagctgcgactacagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaataaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaatctaaatgtattcagttgacaaaatggacacataagggctttttctaaataccgtacataattacacattttcacacttagagggtaatcctatgatacactgtcaatctctattttaaaagactatcaccagaaaagagagaaaagaaaattcatataagaaaaagaaaatgtgaaaaagatcataggcttgggaattccctcaaatccagaaaattccaggttaaggcttgaagttgaatcattcccaggtctagctctaaggttaacaagagtacaaggcaaacaatttctttggggacaagcagcattatttcaattagaccttctcctgcagggcaaaaatcattcttccccacactatgaatggactccaagtatcataataagcaggtaaactcacaagaaccaaagctgacatatggataaaagcagcaagatcacagtacaccaaagtatcatatatatagaagaaataattcaatgtcttagatttgtctataaaaatttgtgatctatataggacttcattcacatggacactaacgataaggagtatttgctttggcggtagtggatcacacatctgcttatcttgctttgatattttttacataatgtttctgagtgatacagatgtgagtcaggtagcatttgatttccccacatatacacaactgaggtgccctgccattggcatcccctgggatccttgattcactgacgttagccatacgaatccagtgttcaaactcagaataataagcttagtttctgcattatcagtcagcataaataataaatccagaaaacgtgctgtatttgttgttgtttcctccatgggctttcccgccatctaatttgatatagacttcatctcccggctccaaatgaagaaccacactgttactggcatagtcgtaattctgatcagcatcttgggcaattgcactagcacgcactgtttttgcagagatcagcccacatgctggtgccgtcccctccgcgcatcaggacgtggtaggtgaagaagtagatgcccgggatggagcaggtgaacttgccggtggtggggtcg

SEQ ID NO: 317024 - DNA, 4789 bp, Homo sapiens
ccagagggcgaagtgggagggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaataaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaatctaaatgtattcagttgacaaaatggacacataagggctttttctaaataccgtacataattacacattttcacacttagagggtaatcctatgatacactgtcaatctctattttaaaagactatcaccagaaaagagagaaaagaaaattcatataagaaaaagaaaatgtgaaaaagatcataggcttgggaattccctcaaatccagaaaattccaggttaaggcttgaagttgaatcattcccaggtctagctctaaggttaacaagagtacaaggcaaacaatttctttggggacaagcagcattatttcaattagaccttctcctgcagggcaaaaatcattcttccccacactatgaatggactccaagtatcataataagcaggtaaactcacaagaaccaaagctgacatatggataaaagcagcaagatcacagtacaccaaagtatcatatatatagaagaaataattcaatgtcttagatttgtctataaaaatttgtgatctatataggacttcattcacatggacactaacgataaggagtatttgctttggcggtagtggatcacacatctgcttatcttgctttgatattttttacataatgtttctgagtgatacagatgtgagtcaggtagcatttgatttccccacatatacacaactgaggtgccctgccattggcatcccctgggatccttgattcactgacgttagccatacgaatccagtgttcaaactcagaataataagcttagtttctgcattatcagtcagcataaataataaatccagaaaacgtgctgtatttgttgttgtttcctccatgggctttcccgccatctaatttgatatagacttcatctcccggctccaaatgaagaaccacactgttactggcatagtcgtaattctgatcagcatcttgggcaattgcactagcacgcactgtttttgcagagatcagcccacatgctggtgccgtcccctccgcgcatcaggacgtggtaggtgaagaagtagatgcccgggatggagcaggtgaacttgccggtggtggggtcg

SEQ ID NO: 317025 - DNA, 4363 bp, Homo sapiens
ccagagggcgaagtgggagggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcaccttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaataaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatattggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaatctaaatgtattcagttgacaaaatggacacataagggctttttctaaataccgtacataattacacattttcacacttagagggtaatcctatgatacactgtcaatctctattttaaaagactatcaccagaaaagagagaaaagaaaattcatataagaaaaagaaaatgtgaaaaagatcataggcttgggaattccctcaaatccagaaaattccaggttaaggcttgaagttgaatcattcccaggtctagctctaaggttaacaagagtacaaggcaaacaatttctttggggacaagcagcattatttcaattagaccttctcctgcagggcaaaaatcattcttccccacactatgaatggactccaagtatcataataagcaggtaaactcacaagaaccaaagctgacatatggataaaagcagcaagatcacagtacaccaaagtatcatatatatagaagaaataattcaatgtcttagatttgtctataaaaatttgtgatctatataggacttcattcacatggacactaacgataaggagtatttgctttggcggtagtggatcacacatctgcttatcttgctttgatattttttacataatgtttctgagtgatacagatgtgagtcaggtagcatttgatttccccacatatacacaactgaggtgccctgccattggcatcccctgggatccttgattcactgacgttagccatacgaatccagtgttcaaactcagaataataagcttagtttctgcattatcagtcagcataaataataaatccagaaaacgtgctgtatttgttgttgtttcctccatgggctttcccgccatctaatttgatatagacttcatctcccggctccaaatgaagaaccacactgttactggcatagtcgtaattctgatcagcatcttgggcaattgcactagcacgcactgtttttgcagagatcagcccacatgctggtgccgtcccctccgcgcatcaggacgtggtaggtgaagaagtagatgcccgggatggagcaggtgaacttgccggtggtggggtcg

SEQ ID NO: 317026 - DNA, 2903 bp, Homo sapiens
cccggaactactcccacaggggggcggggaaggaagatggcggcgcccagcgtcccgtgaggagagaggacacagggatcccggggagcggccccagactcgtaaattatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgtatgtcacacagctgaacagaagccacaaccagcaagtaagacccaagccagaaccagtagcatctcctttccttgaaaaaacatcttcaggtcaagccaaagcagaaatatatgagatgagacctctctcaccgcccagcctatctttgtccagaaagccaaatgaaaaggaattgatagaactagagccagactcagtaattgaagactcaatagatgtagggaaagagacaaaagaggaaaagcggtggaaagagatgaagctgcaagtgtatgatttgccaggaattttggctcgactatccaaaatcaaactcacagctctggttgtaagtaccactgcagctggatttgcattggctccgggcccttttgactggccctgtttcctgcttacttctgttgggacaggccttgcatcctgtgctgccaactccatcaatcagttttttgaggtgccatttgactcaaacatgaataggacaaagaacagaccgctggttcgtggacagatcagcccattgctagctgtgtcctttgccacttgttgtgctgttccgggagttgccattctgaccttgggggtgaatccactcacaggagccctggggctcttcaacattttcctgtatacctgctgctacacaccactgaaaaggatcagcattgccaacacatgggtcggagctgtggttggggccatcccgcctgtcatgggctggacagcggccacgggcagcctcgatgctggcgcatttctcctgggaggaatcctctactcctggcagtttcctcatttcaacgccctgagctggggcctccgtgaagactactcccggggcggctactgcatgatgtcggtcacccacccgggcctgtgccggcgcgtggcgctgcgccactgcctggccctgctcgtgctgtccgcagcagcccctgtgctggacatcaccacatggaccttccccatcatggcccttcccatcaatgcgtacatctcctacctcggcttccgcttctacgtggacgcagaccgcaggagctcgcggagactgttcttctgcagcctgtggcacctgccgctgctgctgctgctcatgctcacctgcaagcggccgagcggaggcggggacgcagggccccctcccagctgagagcactgggacgcccaccgcccctttccctccgctgccaggcgagcatgttgtggtaattctggaacacaagaagagaaattgctgggtttagaacaagattataaacgaattcggtgctcagtgatcacttgacagttttttttttttttaaatattacccaaaatgctccccaaataagaaatgcatcagctcagtcagtgaatacaaaaaaggaattatttttccctttgagggtctttatacatctctcctccaaccccaccctctattctgtttcttcctcctcacatgggggtacacatacacagcttcctcttttggttccatccttaccaccacaccacacgcacactccacatgcccagcagagtggcacttggtggccagaaagtgtgagcctcatgatctgctgtctgtagttctgtgagctcaggtccctcaaaggcctcggagcacccccttcctggtgactgagccagggcctgcatttttggttttccccaccccacacattctcaaccatagtccttctaacaataccaatagctaggacccggctgctgtgcactgggactggggattccacatgtttgccttgggagtctcaagctggactgccagcccctgtcctcccttcacccccattgcgtatgagcatttcagaactccaaggagtcacaggcatctttatagttcacgttaacatatagacactgttggaagcagttccttctaaaagggtagccctggacttaataccagccggatacctctggcccccaccccattactgtacctctggagtcactactgtgggtcgccactcctctgctacacagcacggctttttcaaggctgtattgagaagggaagttaggaagaagggtgtgctgggctaaccagcccacagagctcacattcctgtcccttgggtgaaaaatacatgtccatcctgatatctcctgaattcagaaattagcctccacatgtgcaatggctttaagagccagaagcagggttctgggaattttgcaagttatcctgtggccaggtgtggtctcggttaccaaatacggttacctgcagctttttagtcctttgtgctcccacgggtctgcagagtcccatctgcccaaaggtcttgaagcttgacaggatgttttcattactcagtctcccagggcactgctggtccgtagggattcattggtcggggtgggagagttaaacaacatttaaacagagttctctcaaaaatgtctaaagggattgtaggtagataacatccaatcactgtttgcacttatctgaaatcttccctcttggctgcccccaggtatttactgtggagaacattgcataggaatgtctggaaaaagcctctacaacttgttacagccttcacatttgtacaattcattgattctcttttccttccacaataaaatggtatacaaga

SEQ ID NO: 317027 - DNA, 874 bp, Homo sapiens
cccggaactactcccacaggggggcggggaaggaagatggcggcgcccagcgtcccgtgaggagagaggacacagggatcccggggagcggccccagactcgtaaattatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgtatgtcacacagctgaacagaagccacaaccagcaagtaagacccaagccagaaccagtagcatctcctttccttgaaaaaacatcttcaggtcaagccaaagcagaaatatatgagatgagacctctctcaccgcccagcctatctttgtccagaaagccaaatgaaaaggaattgatagaactagagccagactcagtaattgaagactcaatagatgtagggaaagagacaaaagaggaaaagcggtggaaagagatgaagctgcaagtgtatgatttgccaggaattttggctcgactatccaaaatcaaactcacaggtactttgtttttctgatatacttacttatttgaaactctatctttagtgaaacaaaaagctaattttatttaccacctgaaaagaataatttggaactgcaggtcctgtcttagtatttttcctctcttcaatttaactgggatttgaaattaaattttcttgaattctatttacacagaattgtaaatagtattgcattgtaagtattgtattaaaaatagtcaccctttcctttgcaattaaagttgaatgtttatcctgctta

SEQ ID NO: 317028 - DNA, 3534 bp, Homo sapiens
cccggaactactcccacaggggggcggggaaggaagatggcggcgcccagcgtcccgtgaggagagaggacacagggatcccggggagcggccccagactcgtaaattatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgtatgtcacacagctgaacagaagccacaaccagcaagtaagacccaagccagaaccagtagcatctcctttccttgaaaaaacatcttcaggtcaagccaaagcagaaatatatgagatgagacctctctcaccgcccagcctatctttgtccagaaagccaaatgaaaaggaattgatagaactagagccagactcagtaattgaagactcaatagatgtagggaaagagacaaaagaggaaaagcggtggaaagagatgaagctgcaagtgtatgatttgccaggaattttggctcgactatccaaaatcaaactcacagctctggttgtaagtaccactgcagctggatttgcattggctccgggcccttttgactggccctgtttcctgcttacttctgttgggacaggccttgcatcctgtgctgccaactccatcaatcagttttttgaggtgccatttgactcaaacatgaataggacaaagaacagaccgctggttcgtggacagatcagcccattgctagctgtgtcctttgccacttgttgtgctgttccgggagttgccattctgaccttgggggtgaatccactcacaggagccctggggctcttcaacattttcctgtatacctgctgctacacaccactgaaaaggatcagcattgccaacacatgggtcggagctgtggttggggccatcccgcctgtcatgggctggacagcggccacgggcagcctcgatgctggcgcatttctcctgggaggaatcctctactcctggcagtttcctcatttcaacgccctgagctggggcctccgtgaagactactcccggggcggctactgcatgatgtcggtcacccacccgggcctgtgccggcgcgtggcgctgcgccactgcctggccctgctcgtgctgtccgcagcagcccctgtgctggacatcaccacatggaccttccccatcatggcccttcccatcaatgcgtacatctcctacctcggcttccgcttctacgtggacgcagaccgcaggagctcgcggagactgttcttctgcagcctgtggcacctgccgctgctgctgctgctcatgctcacctgcaagcggccgagcggaggcggggacgcagggccccctcccagctgagagcactgggacgcccaccgcccctttccctccgctgccaggcgagcatgttgtggtaattctggaacacaagaagagaaattgctgggtttagaacaagattataaacgaattcggtgctcagtgatcacttgacagttttttttttttttaaatattacccaaaatgctccccaaataagaaatgcatcagctcagtcagtgaatacaaaaaaggaattatttttccctttgagggtctttatacatctctcctccaaccccaccctctattctgtttcttcctcctcacatgggggtacacatacacagcttcctcttttggttccatccttaccaccacaccacacgcacactccacatgcccagcagagtggcacttggtggccagaaagtgtgagcctcatgatctgctgtctgtagttctgtgagctcaggtccctcaaaggcctcggagcacccccttcctggtgactgagccagggcctgcatttttggttttccccaccccacacattctcaaccatagtccttctaacaataccaatagctaggacccggctgctgtgcactgggactggggattccacatgtttgccttgggagtctcaagctggactgccagcccctgtcctcccttcacccccattgcgtatgagcatttcagaactccaaggagtcacaggcatctttatagttcacgttaacatatagacactgttggaagcagttccttctaaaagggtagccctggacttaataccagccggatacctctggcccccaccccattactgtacctctggagtcactactgtgggtcgccactcctctgctacacagcacggctttttcaaggctgtattgagaagggaagttaggaagaagggtgtgctgggctaaccagcccacagagctcacattcctgtcccttgggtgaaaaatacatgtccatcctgatatctcctgaattcagaaattagcctccacatgtgcaatggctttaagagccagaagcagggttctgggaattttgcaagttatcctgtggccaggtgtggtctcggttaccaaatacggttacctgcagctttttagtcctttgtgctcccacgggtctgcagagtcccatctgcccaaaggtcttgaagcttgacaggatgttttcattactcagtctcccagggcactgctggtccgtagggattcattggtcggggtgggagagttaaacaacatttaaacagagttctctcaaaaatgtctaaagggattgtaggtagataacatccaatcactgtttgcacttatctgaaatcttccctcttggctgcccccaggtatttactgtggagaacattgcataggaatgtctggaaaaagcctctacaacttgttacagccttcacatttgtacaattcattgattctcttttccttccacaataaaatggtatacaagaacaggagtgtgtgtgacgtcattggaagtaatcatcctgtgctgagttcgcacagttcttggtagaaccgacacttgatcacgccttcaagagctggcagagggtgcgtgggaggttggttttgtttcgtaaattgacaaattgtagttgtgtatatttatgaggtaataaagtgatgttatgatttatgaagacaattgaaataatgaaatcaagctgatgaatgtattcattacctcagatacttatttttgtgataagaacatttttaatgtactcagtaattttgaaattagaatacattatttcctgcattcacacagtgtgtgatgtacgtcaaagggaggagacgtactcatcataactgactttgtaccctttcaccatcttgtacccattccgttcaactcccagcctctctaaccaccattctactctctgcttcaagtctgattattctggattccacatagaagtaagaacatgcagtatttatctttctgtgccatattaagttgagaactttaaccttttcgcttaagagcagcaccttctggcttctctgacatctctggattgccagcatcactatgtgaggccatgattaagcaaaataaagcttactgagcac

SEQ ID NO: 317029 - DNA, 2853 bp, Homo sapiens
cccggaactactcccacaggggggcggggaaggaagatggcggcgcccagcgtcccgtgaggagagaggacacagggatcccggggagcggccccagactcgtaaattatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgtatgtcacacagctgaacagaagccacaaccagcaagtaagacccaaccaaagcagaaatatatgagatgagacctctctcaccgcccagcctatctttgtccagaaagccaaatgaaaaggaattgatagaactagagccagactcagtaattgaagactcaatagatgtagggaaagagacaaaagaggaaaagcggtggaaagagatgaagctgcaagtgtatgatttgccaggaattttggctcgactatccaaaatcaaactcacagctctggttgtaagtaccactgcagctggatttgcattggctccgggcccttttgactggccctgtttcctgcttacttctgttgggacaggccttgcatcctgtgctgccaactccatcaatcagttttttgaggtgccatttgactcaaacatgaataggacaaagaacagaccgctggttcgtggacagatcagcccattgctagctgtgtcctttgccacttgttgtgctgttccgggagttgccattctgaccttgggggtgaatccactcacaggagccctggggctcttcaacattttcctgtatacctgctgctacacaccactgaaaaggatcagcattgccaacacatgggtcggagctgtggttggggccatcccgcctgtcatgggctggacagcggccacgggcagcctcgatgctggcgcatttctcctgggaggaatcctctactcctggcagtttcctcatttcaacgccctgagctggggcctccgtgaagactactcccggggcggctactgcatgatgtcggtcacccacccgggcctgtgccggcgcgtggcgctgcgccactgcctggccctgctcgtgctgtccgcagcagcccctgtgctggacatcaccacatggaccttccccatcatggcccttcccatcaatgcgtacatctcctacctcggcttccgcttctacgtggacgcagaccgcaggagctcgcggagactgttcttctgcagcctgtggcacctgccgctgctgctgctgctcatgctcacctgcaagcggccgagcggaggcggggacgcagggccccctcccagctgagagcactgggacgcccaccgcccctttccctccgctgccaggcgagcatgttgtggtaattctggaacacaagaagagaaattgctgggtttagaacaagattataaacgaattcggtgctcagtgatcacttgacagttttttttttttttaaatattacccaaaatgctccccaaataagaaatgcatcagctcagtcagtgaatacaaaaaaggaattatttttccctttgagggtctttatacatctctcctccaaccccaccctctattctgtttcttcctcctcacatgggggtacacatacacagcttcctcttttggttccatccttaccaccacaccacacgcacactccacatgcccagcagagtggcacttggtggccagaaagtgtgagcctcatgatctgctgtctgtagttctgtgagctcaggtccctcaaaggcctcggagcacccccttcctggtgactgagccagggcctgcatttttggttttccccaccccacacattctcaaccatagtccttctaacaataccaatagctaggacccggctgctgtgcactgggactggggattccacatgtttgccttgggagtctcaagctggactgccagcccctgtcctcccttcacccccattgcgtatgagcatttcagaactccaaggagtcacaggcatctttatagttcacgttaacatatagacactgttggaagcagttccttctaaaagggtagccctggacttaataccagccggatacctctggcccccaccccattactgtacctctggagtcactactgtgggtcgccactcctctgctacacagcacggctttttcaaggctgtattgagaagggaagttaggaagaagggtgtgctgggctaaccagcccacagagctcacattcctgtcccttgggtgaaaaatacatgtccatcctgatatctcctgaattcagaaattagcctccacatgtgcaatggctttaagagccagaagcagggttctgggaattttgcaagttatcctgtggccaggtgtggtctcggttaccaaatacggttacctgcagctttttagtcctttgtgctcccacgggtctgcagagtcccatctgcccaaaggtcttgaagcttgacaggatgttttcattactcagtctcccagggcactgctggtccgtagggattcattggtcggggtgggagagttaaacaacatttaaacagagttctctcaaaaatgtctaaagggattgtaggtagataacatccaatcactgtttgcacttatctgaaatcttccctcttggctgcccccaggtatttactgtggagaacattgcataggaatgtctggaaaaagcctctacaacttgttacagccttcacatttgtacaattcattgattctcttttccttccacaataaaatggtatacaaga

SEQ ID NO: 317030 - DNA, 1325 bp, Homo sapiens
  misc_feature (17)..(17): n is a, c, g, or t
  misc_feature (35)..(35): n is a, c, g, or t
  misc_feature (75)..(75): n is a, c, g, or t
tcaaaaacccaaaaccnaccaaaaaaagctggccnttttaaccataaaattaattatgatgagccatttttagcntcttgtgtcctgtcatattattattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttttcttttggactttgatcttcatttgcaaagagatcccgcacaaatatccagctgcctcactcgcacagtctgtagaaacatccctccaagcctcgcaccagggtagcaaacttcctttttataaagattcataccaaaaaaagcacccaatttgggattgtatgtttgaaaaatcattttctttttaaaaagtgtgaacgttttgctctgttgtgaatgattaattgtatgttttctttagagtctaaagtttagaccccctgccaaaagtgaatattcacaagtatagcgttcagagaaagttctgagtgttgcttgaatttggttatttgagcaacaagtctagaaatgaatgcttgacctagcacccgtgtgaaactagcccgttaagctctccaggtgtctga

SEQ ID NO: 317031 - DNA, 434 bp, Homo sapiens
tagaaggccctataaggttcttcagagattagaatcttagttctcccgtactacattgtcaaaacatatctggatataggaaattgtggaaatgtaaaagctggactcttaaaaatattccttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgagggagggcaaggtggctacacagaaactgggatcctgcttagagtcgagcaacca

SEQ ID NO: 317032 - DNA, 8708 bp, Homo sapiens
  misc_feature (3)..(6): n is a, c, g, or t
  misc_feature (8)..(8): n is a, c, g, or t
ggnnnnangcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccagatttgcctgaagacctggataatctccatttttgtcatgggactgttaaaaacgtttggaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatactataccactcagggacagtctcgcaaaaagggacaccccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacctctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttctttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttttcttttggactttgatcttcatttgcaaagagatcccgcacaaatatccagctgcctcactcgcacagtctgtagaaacatccctccaagcctcgcaccagggtagcaaacttcctttttataaagattcataccaaaaaaagcacccaatttgggattgtatgtttgaaaaatcattttctttttaaaaagtgtgaacgttttgctctgttgtgaatgattaattgtatgttttctttagagtctaaagtttagaccccctgccaaaagtgaatattcacaagtatagcgttcagagaaagttctgagtgttgcttgaatttggttatttgagcaacaagtctagaaatgaatgcttgacctagcacccgtgtgaaactagcccgttaagctctccaggtgtctga

SEQ ID NO: 317033 - DNA, 7832 bp, Homo sapiens
  misc_feature (3)..(6): n is a, c, g, or t
  misc_feature (8)..(8): n is a, c, g, or t
ggnnnnangcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccagatttgcctgaagacctggataatctccatttttgtcatgggactgttaaaaacgtttggaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacctctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttctttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttttcttttggactttgatcttcatttgcaaagagatcccgcacaaatatccagctgcctcactcgcacagtctgtagaaacatccctccaagcctcgcaccagggtagcaaacttcctttttataaagattcataccaaaaaaagcacccaatttgggattgtatgtttgaaaaatcattttctttttaaaaagtgtgaacgttttgctctgttgtgaatgattaattgtatgttttctttagagtctaaagtttagaccccctgccaaaagtgaatattcacaagtatagcgttcagagaaagttctgagtgttgcttgaatttggttatttgagcaacaagtctagaaatgaatgcttgacctagcacccgtgtgaaactagcccgttaagctctccaggtgtctga

SEQ ID NO: 317034 - DNA, 8159 bp, Homo sapiens
  misc_feature (3)..(6): n is a, c, g, or t
  misc_feature (8)..(8): n is a, c, g, or t
ggnnnnangcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccagatttgcctgaagacctggataatctccatttttgtcatgggactgttaaaaacgtttggaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacagatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacctctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttctttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttttcttttggactttgatcttcatttgcaaagagatcccgcacaaatatccagctgcctcactcgcacagtctgtagaaacatccctccaagcctcgcaccagggtagcaaacttcctttttataaagattcataccaaaaaaagcacccaatttgggattgtatgtttgaaaaatcattttctttttaaaaagtgtgaacgttttgctctgttgtgaatgattaattgtatgttttctttagagtctaaagtttagaccccctgccaaaagtgaatattcacaagtatagcgttcagagaaagttctgagtgttgcttgaatttggttatttgagcaacaagtctagaaatgaatgcttgacctagcacccgtgtgaaactagcccgttaagctctccaggtgtctga

SEQ ID NO: 317035 - DNA, 7759 bp, Homo sapiens
  misc_feature (3)..(6): n is a, c, g, or t
  misc_feature (8)..(8): n is a, c, g, or t
ggnnnnangcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacctctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttctttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttttcttttggactttgatcttcatttgcaaagagatcccgcacaaatatccagctgcctcactcgcacagtctgtagaaacatccctccaagcctcgcaccagggtagcaaacttcctttttataaagattcataccaaaaaaagcacccaatttgggattgtatgtttgaaaaatcattttctttttaaaaagtgtgaacgttttgctctgttgtgaatgattaattgtatgttttctttagagtctaaagtttagaccccctgccaaaagtgaatattcacaagtatagcgttcagagaaagttctgagtgttgcttgaatttggttatttgagcaacaagtctagaaatgaatgcttgacctagcacccgtgtgaaactagcccgttaagctctccaggtgtctga

SEQ ID NO: 317036 - DNA, 6304 bp, Homo sapiens
  misc_feature (3)..(3): n is a, c, g, or t
tanacgatcaccttcgcggtatcataaactccgaccccctcaccagggaaggggagcttgacagacggaaggattaaacctgatcaggatgatgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacctctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttctttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttttcttttggactttgatcttcatttgcaaagagatcccgcacaaatatccagctgcctcactcgcacagtctgtagaaacatccctccaagcctcgcaccagggtagcaaacttcctttttataaagattcataccaaaaaaagcacccaatttgggattgtatgtttgaaaaatcattttctttttaaaaagtgtgaacgttttgctctgttgtgaatgattaattgtatgttttctttagagtctaaagtttagaccccctgccaaaagtgaatattcacaagtatagcgttcagagaaagttctgagtgttgcttgaatttggttatttgagcaacaagtctagaaatgaatgcttgacctagcacccgtgtgaaactagcccgttaagctctccaggtgtctga

SEQ ID NO: 317037 - DNA, 5210 bp, Homo sapiens
cctttgccaaggaaccttcacagtaatgctgtaaaatgcgttcaaaagcttaagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttctttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttttcttttggactttgatcttcatttgcaaagagatcccgcacaaatatccagctgcctcactcgcacagtctgtagaaacatccctccaagcctcgcaccagggtagcaaacttcctttttataaagattcataccaaaaaaagcacccaatttgggattgtatgtttgaaaaatcattttctttttaaaaagtgtgaacgttttgctctgttgtgaatgattaattgtatgttttctttagagtctaaagtttagaccccctgccaaaagtgaatattcacaagtatagcgttcagagaaagttctgagtgttgcttgaatttggttatttgagcaacaagtctagaaatgaatgcttgacctagcacccgtgtgaaactagcccgttaagctctccaggtgtctga

SEQ ID NO: 317038 - DNA, 6622 bp, Homo sapiens
  misc_feature (3)..(6): n is a, c, g, or t
  misc_feature (8)..(8): n is a, c, g, or t
ggnnnnangcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccagatttgcctgaagacctggataatctccatttttgtcatgggactgttaaaaacgtttggaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatactataccactcagggacagtctcgcaaaaagggacaccccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacctctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacaggcatctctgtcaccagccgctgccacccatcagtcacaaatctatgggcgctcccagaccgtagccatgcagggtcccgcacggactttaacgatgcagagaggcatgaacatgagtgtgaacctatgccctcacagccacctgtgggtccggc

SEQ ID NO: 317039 - DNA, 3600 bp, Homo sapiens
  misc_feature (3)..(6): n is a, c, g, or t
  misc_feature (8)..(8): n is a, c, g, or t
  misc_feature (3556)..(3556): n is a, c, g, or t
ggnnnnangcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccagatttgcctgaagacctggataatctccatttttgtcatgggactgttaaaaacgtttggaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatactataccactcagggacagtctcgcaaaaagggacaccccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacctctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgntacgagaaggagaaaccgtcgattcgagtaatcctggggtagcc

SEQ ID NO: 317040 - DNA, 460 bp, Homo sapiens
ccccgtgctgatcccattccaatatgtagcttctgtttggggactaaagaatcaaatcgtgaaaagaaaccagaagaactcctctcttgtgcagattgtggcagtagtggtaagttgtgtttttcctatgtgttgtacaatgacttcccattatcatagcttcatgctatttgtctctctattaaaactgtattgttatttaaggcagttatatggtaatagcataggctttaaattttaaaagaaaaagtaaggaatagagaaaaaagcgtgagtatgttagtactgacatatggatattatatatgcttatataatactatacatatttatgattaagcttttattttataccagcattggtaattcagtgtggagatgtctgcattataggtaaattccatgtagagaattctaagctttcaagctgagtacaaccccatctttaaaaattaatagc

SEQ ID NO: 317041 - DNA, 653 bp, Homo sapiens
gccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccaggtaagcgaaggagtaatgttcgtgcattctcactactgtccttttgtcttttacggtttcacttaagttttatgtggacaaaagttctgaataaagtttgataaaattg

SEQ ID NO: 317042 - DNA, 454 bp, Homo sapiens
agtatatatattattattttccttttctttctatttgacagaaaatagagtgtgagagtggggtggaagactgtggccggtacccttctgtgattgaatttggtaaatatgaaatccaaacctggtactcctcgccttacccacaggaatatgcaaggtaatggaataagtctggcaggtgtataacttgaatgtcacatatgtgagaaaggaaaattcttgattctaaagcaggaattagggatgattttaggaaataaattttggtagtcaatgccaagtgcttcccaaactattgcttttgccagcacctttttatggtattccttgttctcggtaaattccttatgctccttagttacatgggcattataaattttgccatttagcttctagattgtgctttctttccttggttaattggggaaatgttggttttgtatgaaaccaaatt

SEQ ID NO: 317043 - DNA, 4334 bp, Homo sapiens
  misc_feature (3)..(6): n is a, c, g, or t
  misc_feature (8)..(8): n is a, c, g, or t
ggnnnnangcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccagatttgcctgaagacctggataatctccatttttgtcatgggactgttaaaaacgtttggaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatactataccactcagggacagtctcgcaaaaagggacaccccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacctctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacc

SEQ ID NO: 317044 - DNA, 536 bp, Homo sapiens
atttaagtaataagtgcttattgtcagtggatgaaaaacttttttatactggccactgtttttggcagatgttgatgattgcttctcttacatgtgttgctgttttgttccctctttaggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaatta

SEQ ID NO: 317045 - DNA, 1077 bp, Homo sapiens
ttgatcttaggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaaccaaa

SEQ ID NO: 317046 - DNA, 685 bp, Homo sapiens
  misc_feature (69)..(69): n is a, c, g, or t
  misc_feature (77)..(77): n is a, c, g, or t
  misc_feature (659)..(660): n is a, c, g, or t
  misc_feature (673)..(673): n is a, c, g, or t
ctctagagaccccaacgtccatcttgcattgagcgcactcgtaacctggatcccagaagttcgcgaagncagtaccntttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaganngacgtccggtacnggctcgattcga

SEQ ID NO: 317047 - DNA, 831 bp, Homo sapiens
actttgattccttgttagggttgtaagtgtatggtttctataagtggtatgtattcctgcattataagcactcgtagaaagcaaataggaaataagccatcattacagcccctaaactcccgattcttgcagtttggtatatttagcaatctgatgtttttgtttgtttgtttaatctacatacaattttgctttttctgagtggtagctatcacaattaacttaaaattgtattttgcctttactacgtaactgaattttcaactgtttaaaagagtcgttactatttgtgtacctattgagcaaaacagtctgaaaacttgtgaatggtttgcagatgtgtcgtatagtgtgctagtcctgaaatttagggaccagaattttttagctattaagaaaaagaaaatgaaaatgaagtagtatctcaggaatagttaaataaaaaaatgaagcttttctgatgttaagaacaaaaccaattctgtgtttaataggactacagagatgtttttgagaaaacatgtatgtttattaactcttgttgtagagtgattttgattttcttgcttgatttttctttcccctgaatttgctgttttgtttaagaatgcaaggccagaaactgtcactaatgacgatgaagaagccttggatgaagaaacaaagaggagagatcagatgattaaaggggctattgaagttttaattcgtgaatactccagcctgggcaactagagtgaaactctgtctccctgctgccaaaaaagaaaaaagaaatacctttcatgttccctccaagttctttgttaaaaaaaaataaaaaccaaagcc

SEQ ID NO: 317048 - DNA, 494 bp, Homo sapiens
cttaatatacatgtgttatgttccagaaggagagttgagagaatgtgggagagttggggaatgttgggaattcaaagagataatagatgagaattttcaggcctgattagtgacataaatctttatattaaggaaagagaaatcctgagcaggagaaaagcaaacacatttgagtacattgttctgaacagaatgaataaaaataaaaccactcttaaacacgttacaggtaaaaggcaaagaggatcttgaaatcaaccaaatataaagattacgtacaaaggaatggcaattaggctggaagaaaatacatcaacagcaataacagaagtgggatggcagtggaataatcttcaaaatgataagtattttatactgatggaacgtcgaattagaccatggattaataagaaaatcatagaatatataggtgaagaagaagctacattagttgattttgtttgttctaaggtcataatcaccgtcacgacatg

SEQ ID NO: 317049 - DNA, 4250 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317050 - DNA, 5077 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgatcctggggactcatattctttcagaatcatgtaaataaatggcatcatgttgtaattgtgtggtgcatactagaaaagttaaaaatatgggctgaactttttatggacttgatttttatgactattggtatctaaaggtcaaggaagccatttacattattttggatgaatctactatacatctatggaaatgtctcttttattttaaattctggtttctcaacggaaaatttcagaaaagatgccccttgccattttcgttaatttttcagtcttttcttagacacacccccagcctaagaccttgttcgaggagtttattgtgtctgtcttttcttaacatactgcactgttcttaagcatcatattgtgttgtttttatttagccactattaacatgaaggtttattcaggtagatttgatttcctttgcttcgtttcttctcctgctctgtcaactgtacttatcttaaagggccactctaaaaacaagggagatgtcgtaatctgaaacctttggggagatgtactctgtactgcataacatctccagtgaggtttgtgacaggacctcaactaaatatatgaatttgtgcaagttcatatattaaagtttctgcagcagagtgaaaattgttacagtaaatgtggtagaaactgttaatcgcttaatgccagtttaaatcatgttttgtaaccaagcttcagtaaaaggctttagattgtcagagttggttgatttttagaattgtatatataaagaattagacattaaacaggcatattctagtgtctgaaaatacacataagaaatttctattaaaaag

SEQ ID NO: 317051 - DNA, 4372 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggacggagtcttactctgtcgttcaggttggagtgcagtggcgcgacctcggctcactgcaacatctgcctcccaggttcaagcaattctcctgcctcaccttccagagtagctgggattacagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317052 - DNA, 4324 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactggttttactagtgctcctatatctgcagctgcctcgagttctgagaagaagtgaaaagtttaattttctagcacttgtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317053 - DNA, 3973 bp, Homo sapiens
ctggggtgagaatcagattcctgtgagggggcatttagctcactggagtattcacgaattaaacttcaatagcccctttaatcatctgatctctcctctttgtttcttcatccaaggcttcttcatcgtcattagtgacagtttctggccttgcattcccattagaagctttcttctttgctttccctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317054 - DNA, 3066 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaatta

SEQ ID NO: 317055 - DNA, 3241 bp, Homo sapiens
ggacatattggcgtactacgcctgagtctctccagcagaatcatcaaactgcgagactcacagtatggaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317056 - DNA, 3203 bp, Homo sapiens
cgacgcttgcttcatggcctacacgttcgaaaacggcatcttcatcggccgatgaagatgccgttttcgcaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317057 - DNA, 2710 bp, Homo sapiens
aacatagtgataaatgacaagataatgcttgttatacatttacatgtagagagcacactctggtgtgttccgtagatacagaacattaagacattctttaacctcttagcatgcaggttgtaatgttgaaaagaggtgctgttggagatgtcatgtttacttctcaatgatcggagtattaaatgaagccttttatcattcacttttacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317058 - DNA, 2246 bp, Homo sapiens
  misc_feature (1993)..(1993): n is a, c, g, or t
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagatgcatacgaacgaaganaacttgaaagaaaactccgagagaaagaagctgcttatcaagagcgccttaagacttgggaaatcagagaacgaaagaaaacccgggaatatgagaaagaagctgaaagagaagaagacagaagaagagaaatggccaaagaagctaaacgactaaaagaattcttagaagatcataataaatatagggttgatgcatccaccctaaatttattatgtaaatataaaccaaattgtcatggcttactgagcta

SEQ ID NO: 317059 - DNA, 2170 bp, Homo sapiens
  misc_feature (1917)..(1917): n is a, c, g, or t
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagagagagagaacgagagcgagaacgagaacgggagcgagagagagagcgagagagggaacgggagcgagaaagagaaaaagacaaaaaacgggaccgagaagaagatgaagaagatgcatacgaacgaaganaacttgaaagaaaactccgagagaaagaagctgcttatcaagagcgccttaagacttgggaaatcagagaacgaaagaaaacccgggaatatgagaaagaagctgaaagagaagaagacagaagaagagaaatggccaaagaagctaaacgactaaaagaattcttagaagatcataataaatatagggttgatgcatccaccctaaatttattatgtaaatataaaccaaattgtcatggcttactgagcta

SEQ ID NO: 317060 - DNA, 1816 bp, Homo sapiens
  misc_feature (1697)..(1697): n is a, c, g, or t
  misc_feature (1721)..(1721): n is a, c, g, or t
  misc_feature (1731)..(1731): n is a, c, g, or t
  misc_feature (1774)..(1774): n is a, c, g, or t
  misc_feature (1797)..(1797): n is a, c, g, or t
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatgggcgaagaagctaaaacganttaaaaagatttttttaggaagantttttgttgnttgattaggaggttgaccccaattttttaccagagggaattgntttttcaggaaaagttttccttntttggagaaaagggaattt

SEQ ID NO: 317061 - DNA, 2385 bp, Homo sapiens
atttccttccttctttattttcttcccttcacccctgcaaatacctgtattgtgctttaaagaaaaaaatttatatttgtgcttggttaggtagatagaagattactaaaaaatgcctttctagctcacgattgttttcatagttttactagtgctcctatatctgcagctgcctcgagttctgagaagaagtgaaaagtttaattttctagcacttgtgagtagtgagttattttttacagttgggatctttctctaagatttgtggaagtatattttgcattgcttttgagggatggtgggttatgaaatgaaacatttggaaattaagtcatcttgctaagagagtgtttttactgtaggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317062 - DNA, 1638 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacatataaaaaaaataataataaaa

SEQ ID NO: 317063 - DNA, 1377 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcaatttggcagtctccagaaaaccagaacacatggtcccaataactacagctaaaaggtgaatgtcagtatttggaagtttccttatagcagtaaactctgaagcacttcacattatatgccttgctttagtttatcagtg

SEQ ID NO: 317064 - DNA, 1167 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagagatcatatggtgactaatgcaagatgaaactctcagcttggaaagtaacaaggaataggataaactggaagaagagaaaggcaaaaagg

SEQ ID NO: 317065 - DNA, 745 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagaatgcagtgagcacagctgcagtcggtaaca

SEQ ID NO: 317066 - DNA, 282 bp, Homo sapiens
tgtattttcagtaaagacagcgtttcaccatgttggccaagctggtctcaaactcctgacctcagatgatctgcccaccgcggcctcccaaagtgctgggattacaggcatgagccaccatacctggccttttctcttttcataaagatattttacaagaggtaatgtaaaacaaaaatcaagttgaatggtgtagagttgtagttaatcagattattgtttgggttttagatggaacaagaggctgagaggcgcaggcagccacaaataaagcaagagcca

SEQ ID NO: 317067 - DNA, 379 bp, Homo sapiens
agaccatggattaataagaaaatcatagaatatataggtgaagaagaagctacattagttgattttgtttgttctaaggttagtcttctattctcttccatgccagcatttattttatatattaaaatattagacacttcttaaaagagcagaaattttacagagtcaagttccatgatggtttaggttcagttaagtgatttatatctgcttttttaaagttatttttatttttggtgtgtttttttttattcactgcagtggatgcagatttatgtctgctttaatgaacctttccatccaacttcagactcctcacaccacatgtttttatttcagtggtcgaggaggatggaattgctggttactgccaattgtg

SEQ ID NO: 317068 - DNA, 4978 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgatcctggggactcatattctttcagaatcatgtaaataaatggcatcatgttgtaattgtgtggtgcatactagaaaagttaaaaatatgggctgaactttttatggacttgatttttatgactattggtatctaaaggtcaaggaagccatttacattattttggatgaatctactatacatctatggaaatgtctcttttattttaaattctggtttctcaacggaaaatttcagaaaagatgccccttgccattttcgttaatttttcagtcttttcttagacacacccccagcctaagaccttgttcgaggagtttattgtgtctgtcttttcttaacatactgcactgttcttaagcatcatattgtgttgtttttatttagccactattaacatgaaggtttattcaggtagatttgatttcctttgcttcgtttcttctcctgctctgtcaactgtacttatcttaaagggccactctaaaaacaagggagatgtcgtaatctgaaacctttggggagatgtactctgtactgcataacatctccagtgaggtttgtgacaggacctcaactaaatatatgaatttgtgcaagttcatatattaaagtttctgcagcagagtgaaaattgttacagtaaatgtggtagaaactgttaatcgcttaatgccagtttaaatcatgttttgtaaccaagcttcagtaaaaggctttagattgtca

SEQ ID NO: 317069 - DNA, 4304 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgatcctggggactcatattctttcagaatcatgtaaataaatggcatcatgttgta

SEQ ID NO: 317070 - DNA, 4469 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactggttttactagtgctcctatatctgcagctgcctcgagttctgagaagaagtgaaaagtttaattttctagcacttgtgagtagtgagttattttttacagttgggatctttctctaagatttgtggaagtatattttgcattgcttttgagggatggtgggttatgaaatgaaacatttggaaattaagtcatcttgctaagagagtgtttttactgtaggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317071 - DNA, 5053 bp, Homo sapiens
ctttgcatgttttggtatgagtttattaaataaccacagactgtcagggtatcagcgtggcagggggcgtccatttacagcacggatgagtctgaagagagaataaggtaagatttatgattttttaatctgtcctttcctcttcatgactttcttacataattttagactcacctcatttcccttctccagtctttctttaaaaatatacatgtatatgtttacatgtatacctgtatttgtatacatgtgtgtatatatatatatatatatatctcatatataaacttcaggaaacatttagtatggactagattcactcactttttcatttacttagaaccaaacttttgaaatgagttctgaaacaaatggttatttatataactgaatataaggagcacagtgaaataagcaagaattaaaaattgaggaattctacaggaaaaattagtattggaacatgtatgccattgaggtaagttttatatagtctagcctcattttacaatataaatttttatattcattggaactgtttcagaaatgagatttttccccctttaatagctgttagtttctgtcctctttctatcatatcttatttcatccctttgtaatttcaatgtattcagttttgactttgcccgtattctacttcgatatagactggcacagcaactgaatatattgctcatacattagctttcctttcataacctgctataagttctctgatccatgaggaagagaaaaagagtatctgacaggtaagattgctttttaaagttgttttaaatgcattacatgactgagaaaagaaaaatgcacattttattgttgcagtttaaaatttcattttggtgaaactaaacgtgaaacaaaagggataaatgtgttttgttttgttttgttttacctgtttggggtatttttttctgagtttgtgtagaaaccgtgtggtacactggtaatcttgtcagggtacaaacttggtctgactttgttatttggtttatttgtgaaccatgtacttgctcttcctcccagaaacatagcttgtaggcaaggttaatccagtgtggcgatccatgtcctagcacagcatctgtaagttaatgcacaatcgttccttccaaggatggatttatcattgtaaatatattttcattgtcttacaggcataatgggcataagtatgttgcttttaaatattttaaattaaactattacagttacatatattttgcttgaagtgagtgattttcaaactttttgtatttggtgggctgtccatcttgtaatggtgggagtaaatgtttccatagatgataaggcagttcttggctgaattcagcttgtgtttcttttggagggtgggcaaatcagagggcagagattatttagttgcattataggtattcttctataccacttgccctttgaaaccctcaacttgaggtaatgtgcagtctggggttttaattagtattaataatcttgtggatttacagaaatctataatgcacagagttgagttttaaccaatgatcgtattcatagaaaatatttcgaaccaccacattcttcatggtcattttagttagtacatagtcattgagtggccagccacacctgacacaatctcccagcatccaagattggagattcctggtctgtgtagagtatatggttttgcacgaaatctttctagtcttgtgattgcttcagtttaatttgtcacataaaaccacaagtatttaatattaatgtatcagtggtttggtgtttttgttcccagtactgggctttgcgccgggaaaaatctgaatactggagctacagagttaactctaaaagtgcttttattggtttctagaaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317072 - DNA, 4103 bp, Homo sapiens
actttgattccttgttagggttgtaagtgtatggtttctataagtggtatgtattcctgcattataagcactcgtagaaagcaaataggaaataagccatcattacagcccctaaactcccgattcttgcagtttggtatatttagcaatctgatgtttttgtttgtttgtttaatctacatacaattttgctttttctgagtggtagctatcacaattaacttaaaattgtattttgcctttactacgtaactgaattttcaactgtttaaaagagtcgttactatttgtgtacctattgagcaaaacagtctgaaaacttgtgaatggtttgcagatgtgtcgtatagtgtgctagtcctgaaatttagggaccagaattttttagctattaagaaaaagaaaatgaaaatgaagtagtatctcaggaatagttaaataaaaaaatgaagcttttctgatgttaagaacaaaaccaattctgtgtttaataggactacagagatgtttttgagaaaacatgtatgtttattaactcttgttgtagagtgattttgattttcttgcttgatttttctttcccctgaatttgctgttttgtttaagaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317073 - DNA, 3301 bp, Homo sapiens
aacgggagcgagaaagagaaaaagacaaaaaacgggaccgagaagaagatgaagaagatgcatacgaacgaagaaaacttgaaagaaaactccgagagaaagaagctgcttatcaagagcgccttaagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317074 - DNA, 3032 bp, Homo sapiens
ccaacatgaacaattttaattgaaaacaccagtcataaactattaccacccccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317075 - DNA, 2730 bp, Homo sapiens
atgtttgtcttaaaattatgtgaagagaaattcctataagtctccctcttactcttggtttatgtctgggtcagaaaaatctgtttacacaaaaaagggaagagtaatctttattacttgtatgttaattttatacattgtccttatttcctcaaaggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317076 - DNA, 1766 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagacatattcccctcctttgaaacctagcattaaatgg

SEQ ID NO: 317077 - DNA, 2331 bp, Homo sapiens
atttccttccttctttattttcttcccttcacccctgcaaatacctgtattgtgctttaaagaaaaaaatttatatttgtgcttggttaggtagatagaagattactaaaaaatgcctttctagctcacgattgttttcatagttttactagtgctcctatatctgcagctgcctcgagttctgagaagaagtgaaaagtttaattttctagcacttgtgagtagtgagttattttttacagttgggatctttctctaagatttgtggaagtatattttgcattgcttttgagggatggtgggttatggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttga

SEQ ID NO: 317078 - DNA, 1500 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaagg

SEQ ID NO: 317079 - DNA, 1961 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaaccaaa

SEQ ID NO: 317080 - DNA, 1369 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctcactttaatatgaatagaagctaattttatttttagatttcaacataaacatcaaggtcagactta

SEQ ID NO: 317081 - DNA, 650 bp, Homo sapiens
gcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaaggtatgtcatttttttccttatttgctgaaatcactttaactaacctgtgtgcttaaat

SEQ ID NO: 317082 - DNA, 271 bp, Homo sapiens
aatggatggatgcatggatggatggatagtggatggatagatggttgggtaggtgggtggatggagggatggagggatggatggataatagatggatgcatagatggatgcatgcatggatggatggatagatgggtgagcagatggaaggatgaatgctttgatggatgggtgatgcagagaggcaggaacagcctcgggcctcattctgggctcccattctctttcagcactttcattcaccctactattctttataacttatttttgt

SEQ ID NO: 317083 - DNA, 301 bp, Homo sapiens
ttcatgaatacaatactttaattgcactgtacaaacacaacacggctgggacaccaacgaatgaaaaaagtcattaactgtgaacatttttttttttttttttttttttttttgggggggggatttttttttttttcccccggttgggggaaaagggccccttttgggcccccctttccctttgggggaaagggtttttcgggccctaaccccccggggggggggggccccccgggggaaaaccccccccggggggccccgggcctaattttgaaaaatgggccatgggtttttcccgggg

SEQ ID NO: 317084 - DNA, 403 bp, Homo sapiens
tagcatttgacatttaatgatggggtaaataaccttggttagaattaaaataataaaatacaaactaattttatttaattattcaagcccaggccatacataaaagcactgaggatcaaacataaatatccacaagggtgccagtgacagccaacaggcatgtgcaaaccacctctcacaatacgttttaaagatcaagcagtctttcaaagcacagtcatccatttgccgtggttttgtagcactgatattatacatattttatatatagttccattaactgaatgtcaaagctgcctgtgtgacacctaagaaaattcagtgagagcaatactaagacataaagatttttgttggatgggttggactttggagggccacggaccattatctaaggtttttt

SEQ ID NO: 317085 - DNA, 502 bp, Homo sapiens
gttgtctttcaccatgtgaatggagaagttcctggttcttcatatgccaaatgattttggattaaatccgacacatcttaaatattatgttgtgagattctgggtcttgtttaatcctgtggtgaatatgaatagttttttttagcagtctgattagtcagactgaaagtttaaaactgcagtggttccaatgtcaagtcagttttaaaagccttgcaatgttatttggatctactccatctgcacatcagctggtggtcagtttgggatcaccaaactgggtggagatctgtcttttagttcaactctctcttttatcttattacattttattttattgtggtaagaacttttaacatgtaatataccttcttgacagagttttaagtatacattattgttgattatagttaaaaggttgtacagaagatctctagagcttattcatcttgattaattgaaacttaatgccccttgattagtaactccccattttcctccc

SEQ ID NO: 317086 - DNA, 3175 bp, Homo sapiens
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaat

SEQ ID NO: 317087 - DNA, 555 bp, Homo sapiens
taaatgtttatgtaactttgaaaaaaaagcctttgaagaaaataattgaatgctgtctgggagacagatttctttcagcacttaaagtacataacacactacttttacttttcccacttgattttaaattatcagggttattaagaccttaaaattattttaccaggtttttacatgtgagctgtgacatgactggcattttctttgatttcagcgtatgttggtctctacacatgaaatttgtgtgacttaaaactttctctaaaactgtacttttagttatgatatgcatagaaagcagtatcaaatattgcgtcaaatgactaataacacttaatttctagagttgtggttttattgagccaaaagttgatatgaaaaaaagtcagtaaggaaagtcagtgaagtgcttgcttttttgataattgcactcccaataattttgatattccaacgtacttggtttgcttgttttcacgttaatgttttctgtttattggagtgggaaggcattaaaattgtcattgaagactttgtctttgaaaaaaagtagta

SEQ ID NO: 317088 - DNA, 582 bp, Homo sapiens
gcaaaatggaataaaaaatctgttaaaaatatatttcactaaatagtttaagatgagtcatatttgtgggttttcattttaaattttctttctctaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttat

SEQ ID NO: 317089 - DNA, 5578 bp, Homo sapiens
  misc_feature (3791)..(3791): n is a, c, g, or t
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggttttttttttttttttttttttttttttaaatgtgcagtgttgaatcatttcttcatagtgctcccccgagttgggactagggcntcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtca

SEQ ID NO: 317090 - DNA, 8829 bp, Homo sapiens
  misc_feature (3791)..(3791): n is a, c, g, or t
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggttttttttttttttttttttttttttttaaatgtgcagtgttgaatcatttcttcatagtgctcccccgagttgggactagggcntcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcattgtgtgggtgttttattaaatgagagtttataattcaaattgcttaagtccattgaagttttaattaatgggcagccaaatgtgaatacaaagttttcagtttttttttttcctgctgtccttcaaagcctactgtttaaaaaaaaaaaaaaaaaaaacatggcctgagagtagagtatctgtctactcatgtttaattaaggaaaaacacttatttttagggctttagtcatcacttcataaattgtataagcacattaaatagcgttctagtcctgaaaaagtccaagattcttagaaaattgtgcatatttttattatgacagatgtttgaagataattccccagaatggatttgatactttagatttcaattttgtggcttttgtctattattctgtactctgccatcagcatatggaaagcttcatttactcatcatgacttgtgccatataaaaattgatatttcggaatagtctaaaggactttttgtacttgaatttaatcatgttgtttctaatattcttaaaagcttgaagactaaagcatatcctttcaacaaagcatagtaaggtaataagaaagtgtagtttgtacaagtgttaaaaaaataaagtagacaatgttacagtgggacttattatttcaagtttacattttctccatgtaattttttaaaaagtaaatgaaaaaatgtgcaataatgtaaaatatgaagtgtatgtgtacacacattttatttttcggtatcttgggtatacgtatggttgaaaactatactggagtctaaaagtattctaatttataagaagacattttggtgatgtttgaaaaatagaaatgtgctagttttgtttttatatcatgtcctttgtacgttgtaatatgagctggcttggttcagtaaatgccatcaccatttccattgagaatttaaaactcaccagtgtttaatatgcaggcttccaaaggcttatgaaaaaaatcaagacccttaaatctagttaatttgctgctaacatgaaactctttggttcttttatttttgccagataattagacacacatctaaagcttagtcttaaatggcttaagtgtagctattgattagtgctgttgctagttcagaaagaaatgtttgtgaatggaaacaagaatattcagtccaaactgttgtaaggacagtacctgaaaaccaggaaacaggataatggaaaaagtcttttaaagatgaaatgttggagccaactttcttatagaattaattgtatgtggctatagaaagcctaatgattgttgcttatttttgagagcatattattcttttatgaccataatcttgctgtttttccatcttccaaaagatcttccttctaatatgtatatcagaatgtgggtagccagtcagacaaattcatattggttggtagctttaaaaagtttgtaatgtgaagacaggaaaggacaaaatagtttgctttggtggtagtactctggttgttaagctaggtattttgagactacttccccatcacaacaacaataaaataatcactcataatcctatcacctggagacatagccatcgttaatatgttagtgactatacaatcatgttttcttctgtatatccatgtatattctttaaaaatgaaatttatactgtacctgatctcaaagctttttagcttagtatatctgtcatgaatttgtaggatgttccattgcatcagaaaacggacagtgatttgattactttctaatgccacagatgcagattacatgtagttattgagaatcctttcgaattcagtggcttaatcatgaatgtctaaatattgttgacattaggatgatacatgtaaattaaagttacatttgtttagcatagacaagcttaacattgtagatgtttctcttcaaaaatcatcttaaacatttgcatttggaattgtgttaaatagaatgtgtgaaacactgtattagtaaacttcatcacctttctacttccttatagtttgaacttttcagtttttgtagttcccaaacagttgctcaatttagagcaaattaatttaacacctgccaaaaaaaggctgctgttggcttatcagttgtctttaaattcaaatgctcatgtgacttttatcacatcaaaaaatatttcattaatgattcacctttagctctgaaaattaccgcgtttagtaattatagtgggcttataaaaacatgcaactctttttgatagttatttgagaattttggtgaaaaatatttagctgagggcagtatagaacttataaaccaatatattgatatttttaaaacatttttacatataagtaaactgccatctttgagcataactacatttaaaaataaagctgcatatttttaaatcaagtgtttaacaagaatttatattttttattttttaaaattaaaaataatttatatttcctctgttgcatgaggattctcatctgtgcttataatggttagagattttatttgtgtggaatgaagtgaggcttgtagtcatggttctagtgtttcagtttgccaagtctgtttactgcagtgaaattcatcaaatgtttcagtgtggttttctgtagcctatcatttactggctatttttttatgtacacctttaggattttctgcctactctatccagttgtccaaatgatatcctacattttacaaatgccctttcagtttctattttctttttccattaaattgccctcatgtcctaatgtgcagtttgtaagtgtgtgtgtgtgtgtctgtgtgtgtgtgaatttgattttcaagagtgctagacttccaatttgagagattaaataatttaattcaggcaaacatttttcattggaatttcacagttcattgtaatgaaaatgttaatcctggatgacctttgacatacagtaatgaatcttggatattaatgaatttgttagtagcatcttgatgtgtgttttaatgagttattttcaaagttgtgcattaaaccaaagttggcatactggaagtgtttatatcaagttccatttggctactgatggacaaaaaatagaaatgccttcctatggagagtatttttcctttaaaaaattaaaaaggttaattattttgacaaaaaaacaacaagacaacacaaccacaccagagagaagaaacccaaaacatccaaaacaacaaaacaagggggggggcgaataaacaccgggggccaa

SEQ ID NO: 317091 - DNA, 5524 bp, Homo sapiens
  misc_feature (3791)..(3791): n is a, c, g, or t
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggttttttttttttttttttttttttttttaaatgtgcagtgttgaatcatttcttcatagtgctcccccgagttgggactagggcntcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtca

SEQ ID NO: 317092 - DNA, 5662 bp, Homo sapiens
  misc_feature (3791)..(3791): n is a, c, g, or t
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggttttttttttttttttttttttttttttaaatgtgcagtgttgaatcatttcttcatagtgctcccccgagttgggactagggcntcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcaaaaaaacaacacccaccccacaaaacaattttgggcgcccggccccaaaaaaattttaaccccccctgggggggcggggcccag

SEQ ID NO: 317093 - DNA, 5530 bp, Homo sapiens
  misc_feature (3743)..(3743): n is a, c, g, or t
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggttttttttttttttttttttttttttttaaatgtgcagtgttgaatcatttcttcatagtgctcccccgagttgggactagggcntcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtca

SEQ ID NO: 317094 - DNA, 5436 bp, Homo sapiens
  misc_feature (3649)..(3649): n is a, c, g, or t
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggttttttttttttttttttttttttttttaaatgtgcagtgttgaatcatttcttcatagtgctcccccgagttgggactagggcntcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtca

SEQ ID NO: 317095 - DNA, 2331 bp, Homo sapiens
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactga

SEQ ID NO: 317096 - DNA, 3794 bp, Homo sapiens
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagaccaggtctacagtgatagagcaaagcatcaagaatctttaagggaggttcaacaacaaaacaacatcacaaaaaaccttttggggcgcccttggcctcgaaaatttttagaaccttctgttgggcgccgcgcgcccccctaggttatgcgcaa

SEQ ID NO: 317097 - DNA, 2575 bp, Homo sapiens
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttat

SEQ ID NO: 317098 - DNA, 4628 bp, Homo sapiens
  misc_feature (7)..(7): n is a, c, g, or t
  misc_feature (11)..(12): n is a, c, g, or t
  misc_feature (36)..(36): n is a, c, g, or t
  misc_feature (2841)..(2841): n is a, c, g, or t
catagcngcanngactctcttatttccaccgctcangtgtgggttagttatctctggagtttggccccctttttctctatcatgtgctcatgccctcttttgccatgtgatgccttctaccatgttatgatgcatccagaagactctcaccacatgcagccccttgatcttagacttctcagcttctagaactatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggttttttttttttttttttttttttttttaaatgtgcagtgttgaatcatttcttcatagtgctcccccgagttgggactagggcntcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtca

SEQ ID NO: 317099 - DNA, 2277 bp, Homo sapiens
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtcagttaaattaaacattttgtgggggttggtgacttgtatgtatgtgatgtgtgtttaattctaggagtacagctgatgaagaacttgcttgacaagtttttaacttatgtattatttcgaagcagtgtttacgtagcagtaacatgaaagtttctaataaaatacccaatgtacacagcgtcaa

SEQ ID NO: 317100 - DNA, 1793 bp, Homo sapiens
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggtaagttattttttgatgtttttcctttcctcttcctggatctgagaatttattggaaaacagattttgggtttctttttttccttcagttttattgaggtgtaattgacaagtaaaaattatatataaatacaatgtataatatgatgttttgatgtatgtgtatatacattgtgaaatgattactacagtcaaactacttaacatattcatcacctcacataattattattctc

SEQ ID NO: 317101 - DNA, 1453 bp, Homo sapiens
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtaagaatgctttgattttctatttcaaatattgatgtttatattcatgttgtgttttcatttagaaaagatttctaagccacagaaaaagatactttgtgatgtaaactattattgtagtgctctataatcattttttggcttaccgtacctaatggacttcagggggatacagttcatttgataagaactgaccttatacattacataatcaggtacttatgt

SEQ ID NO: 317102 - DNA, 1532 bp, Homo sapiens
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctgtttttacatgtgagctgtgacatgactggcattttctttgatttcagcgtatgttggtctctacacatgaaatttgtgtgacttaaaactttctctaaaactgtacttttagttatgatatgcatagaaagcagtatcaaatattgcgtcaaatgactaataacacttaatttctagagttgtggttttattgagccaaaagttgatatgaaaaaaagtcagtaaggaaagtcagtgaagtgcttgcttttttgataattgcactcccaataattttgatattccaacgtacttggtttgcttgttttcacgttaatgttttctgtttattggagtgggaaggcattaaaattgtcattgaagactttgtctttgaaaaaaagtagta

SEQ ID NO: 317103 - DNA, 607 bp, Homo sapiens
  misc_feature (90)..(90): n is a, c, g, or t
  misc_feature (94)..(94): n is a, c, g, or t
  misc_feature (102)..(102): n is a, c, g, or t
  misc_feature (105)..(105): n is a, c, g, or t
acacgtgcgctcaaacaattacttggcagacaactctatttggcaattctagaagctaggatgtacagatataatcctgcccaggaaganctcngattgatnagnggtgtgtgtgtgtgtgtgtctgtgtctgtgtgtgtgtgtgtgtgtgtgtctgtgtgtgtgtgaatttgattttcaagagtgctagacttccaatttgagagattaaataatttaattcaggcaaacatttttcattggaatttcacagttcattgtaatgaaaatgttaatcctggatgacctttgacatacagtaatgaatcttggatattaatgaatttgttagtagcatcttgatgtgtgttttaatgagttattttcaaagttgtgcattaaaccaaagttggcatactggaagtgtttatatcaagttccatttggctactgatggacaaaaaatagaaatgccttcctatggagagtatttttcctttaaaaaattaaaaaggttaattattttgacaaaaaaacaacaagacaacacaaccacaccagagagaagaaacccaaaacatccaaaacaacaaaacaagggggggggcgaataaacaccgggggccaa

SEQ ID NO: 317104 - DNA, 496 bp, Homo sapiens
tattcggttttaaactttttattcaacaaataccaagtccctgctgtatatatgggtttggaatacattagtgatcaaaacacaccctctatccctgcccttgaagagtttacactccagtagaggaaacagaatttacattaacaattataaattgtgatacatgctgtggaaagtgaggtgcatgtgataatggttatcaaacattatgctccccaaaatttccatcaccttgcagttgaatgaggcctatgtaactagtttattctaatgtaatacagaaagtagtgtgacactccactttctgtaaaggcaatgaaaaaaatttaccatccagtttcttcccctactgctgtgattaaggattttgcatgttctagatggtgcagctttgtcagcctgggtcttgagtgatactggagcagaactccctcaaattgttccttctgccacgctaaacttgttagatattagcataaataagaaataaaccatt

SEQ ID NO: 317105 - DNA, 196 bp, Homo sapiens
tttttttttttttttacaagttgcagatttgttgccaaatgaacgagtttgtagtattgctaacaaggagaagaattactagcaagtcttgatgttacttttgaagagtgtgatgattgcatttaggaagatatctaaacttctgtttcaaagcaaaaagtatgtgcaaatttcttactcatgacaaattcatata

SEQ ID NO: 317106 - DNA, 5524 bp, Homo sapiens
  misc_feature (3737)..(3737): n is a, c, g, or t
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttattgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggttttttttttttttttttttttttttttaaatgtgcagtgttgaatcatttcttcatagtgctcccccgagttgggactagggcntcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtca

SEQ ID NO: 317107 - DNA, 6020 bp, Homo sapiens
  misc_feature (3791)..(3791): n is a, c, g, or t
  misc_feature (6005)..(6006): n is a, c, g, or t
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggttttttttttttttttttttttttttttaaatgtgcagtgttgaatcatttcttcatagtgctcccccgagttgggactagggcntcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcattgtgtgggtgttttattaaatgagagtttataattcaaattgcttaagtccattgaagttttaattaatgggcagccaaatgtgaatacaaagttttcagtttttttttttcctgctgtccttcaaagcctactgtttaaaaaaaaaaaaaaaaaaaaaaaaaaaaaaaccctattctttccatagccaatccataaagcacatgtaggaccatttctactgaaaaatccaatgtctttttttttgtgtgcagtgttgaatcatttcttcatagtgctcccccgagttgggactagggcttcaatttcacttcttaaaaaaaatcatcatatatttgatatgcccgactgcatacgattttaagcggagtacactactattgtaaagctaatgtgaagatattattaaaaaggttttttttcctcnnagacattctccagt

SEQ ID NO: 317108 - DNA, 5235 bp, Homo sapiens
  misc_feature (3448)..(3448): n is a, c, g, or t
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccaggccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggttttttttttttttttttttttttttttaaatgtgcagtgttgaatcatttcttcatagtgctcccccgagttgggactagggcntcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtca

SEQ ID NO: 317109 - DNA, 4860 bp, Homo sapiens
  misc_feature (3073)..(3073): n is a, c, g, or t
gccttatgtctttctgcataattatagagtagccaaaacctgttttaggttaatcacctctggcaaaataaatgataaaagcatagcttttgtaagcagaatgatattacagaagttaacttataaatctaagtgtattaaagacacttaggaaatttatgataatgctgggtcagcattacagttttaactttttacagtttttcatatgctttttttgtgattttgctgtagaaaattaacagttggcatttggcttagttcaagtataatgctgttgacaagtatatctgacacgtcattgaactaataatatttttgaaagctgataggtacttatttttaaagctatagaggtaatatttcatcagttgcagatttgttgccaaatgaacgagtttgtagtattgctaacaaggagaagaattactagcaagtcttgatgttacttttgaagagtgtgatgattgcatttaggaagatatctaaacttctgtttcaaagcaaaaagtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggttttttttttttttttttttttttttttaaatgtgcagtgttgaatcatttcttcatagtgctcccccgagttgggactagggcntcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtca

SEQ ID NO: 317110 - DNA, 2569 bp, Homo sapiens
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaatcaaatgttaattacctcctaaaaaaaaaaaaaacacaaaaaaaaattttccggggggttgggctcgaaaaattttttaaccctctctggggggcgcggggcccaaaggtttgaacctggcccacgcgccccaggagaacccggggcaacaaaggcgggggttcccccattaaa

SEQ ID NO: 317111 - DNA, 2112 bp, Homo sapiens
  misc_feature (1966)..(1967): n is a, c, g, or t
  misc_feature (1970)..(1970): n is a, c, g, or t
  misc_feature (1979)..(1979): n is a, c, g, or t
  misc_feature (1989)..(1989): n is a, c, g, or t
  misc_feature (1996)..(1997): n is a, c, g, or t
  misc_feature (2011)..(2012): n is a, c, g, or t
  misc_feature (2017)..(2017): n is a, c, g, or t
  misc_feature (2020)..(2021): n is a, c, g, or t
  misc_feature (2027)..(2027): n is a, c, g, or t
tgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaagggacagggtctcactatgttgcccaggctggtctcaaactcctgggcacaagcagtcctcacgctttggcatcccaaagagttggaattacaggacaaatnnttnacttttggnaaatacttcntctaccnngaccagagaaactnngaaangtnnaaatgnaggttatgtgtcagaatccatgccttgcagataaagcggcaataatgcagggattttattcctacttacaaaaatgactgacaag

SEQ ID NO: 317112 - DNA, 1312 bp, Homo sapiens
aatagaatttctcatgttttgacagccgatcaaagtccagatctccatctccaaaaagaaggtaagctaaatgttttgttgccaaatcttgcctgtcaagtgtggcctctgcagaatttgtttgcttactgctttgcagtctttgagctctttggagaattggtgctatatagattaaaatactatgctaagtttctgaaatactttttttttttgattcagtaacattagtttatacttttgctggaaatacttagtcataaaatgttagggtgattattaagatgtgattggtcctgtgagtacttggtagaaattttggtaagatagatgccttttccccacatgtacaatagatacaaagtgtggagaaaagtcttggaaatagttacctgcctagtgcttctttatgaccagaaaacttcaaatagttgtcatatttatctagtgcttcttaatgaccagaagacttcaaatagttgtcatatttaactgcaggttgaccttgcaattttgacaaggaggatagcctaatttttttttttttctgggatggagttttcgctctgtccccaggcttggagtgcagtggctcaatcttggctcactgcagcctccgattcccgggttcaagcaattatcctgtctcagcctcttgagcagttgggattacaggcacccaccgccaagcctggctaattttttgtatttctagtagagacggagtttcaccatgttggcgaggttggtcttaaactcctgatcttaggtgatcacctgcctcggcctctcccaaagtgctggggttacaggcgtgagccaccgtgcctggccagggtagcctaatcttaagccagggacaaaagatgaatatatgtaagtttcatgtcatttttaggtctttgctataggaaattagtaccttaggccacctttgaagttattgaaagttagtacatgtacatgagagtttcaattgacactaattggatccaaacctaatgtttttctttttagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactaga

SEQ ID NO: 317113 - DNA, 2413 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317114 - DNA, 1101 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactaga

SEQ ID NO: 317115 - DNA, 579 bp, Homo sapiens
caagtaattgaaatgggggttccttatgtctggtaacactttgtttgacagtgtgttagacagaataaggcaagtgttgcatcttgtttagttttagcttctttatgcctgaccaacctaatacagtgttgagtagttaaggaaattcctttggactgattgatataattgtgtttttcactttttttattaagatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactaga

SEQ ID NO: 317116 - DNA, 1392 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccacaacccgtcgaggtcaagatcaagatccagctattacgaccaagaagcagccgatcaagtccagactcattcaagagtgtccatagagtctcgatgcttccgcgcgttgggagctctcccatatggactagtgattagtcagccacgccaggggatgaaggactgctacaaggagtgtgaagaggaatggggaccacgggaagctggtggggtcctcacccatctgtggtttttagtccgatggaacagatactatcccatccacagaaagcctttatctactaggagactaagaaaaagaaaaatactcagacttgctaggaccacaggtgtgggtgtttgttgggaaaaagtattgggaagatcggggtccatagggcgaggcgtctctgatcccctttgaggtttaactttctgcttttgatttcctgttagcatttggcctcctacagtggctgactaataaaagggttccggggttttttcccaatccccgtcgaggtcaagctccaagatccaggtctatttccacgacccaagaagccagccgatcaaagtcccagattctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactaga

SEQ ID NO: 317117 - DNA, 943 bp, Homo sapiens
acactgcactccgtatctattactcgtgccacgagaaaaagaacacgctagtacaggaccaggtcaaggtcagcatctcctcgacgatcaagatctatctctcttcgtagatcaagatcagcttcactcagaagatctaggtctggttctataaaaggatcgaggtatttccaatccccgccgaggtattgacacgacccacgtctctctccctcccacaaaaccctcactccgcgcgcctgtgttaccttcccatcctaacctgcttactggtacggctgtcctcttctgccccctctctctccaccgagtgtccccggtcccctatctacggaaatctatgtccactttctcgtcacaaatccgcccccccggcacgccgcaatctcccccatcgtttcccgccgctttgcttaatcgtcccccccctttcatcctcgccgggtcttaacgcgcacttcacccaccgccgattcaagctttcgtccatcgccgcacggcacgtgcccccccccccgcctgcggtcctcccgcttctctcttaggtccccctcgccaccaccacccgtcgcccgtgtttatgccccgaccgcctatatttcgacccttcgatccttaaccctctcccgtgacttccgccgaatcaaccactccctgatactagccccatgctcccgttggccgtggtacggcccgcgccctccatctaccacccggttccgcaccggaaagaccacgtttctccggcaagcccccactcatgtgctccttactctgctcgcgatcgcgagtcaccgccgtcctatcttaattcactgtgacggtgccctactagcttaccccccgcaggcgaaaagcaataatagagtaacggtgagctccgcgtcgtagcactcggtgctttgctgcactatcctgttctcctttccctcttcccctcccg

SEQ ID NO: 317118 - DNA, 908 bp, Homo sapiens
  misc_feature (29)..(29): n is a, c, g, or t
cgtcaatacgtctgaagctacgcccaacncccacacctagtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtaaaaggatcccgtctgagtccagatctccctttgtaatacgaatttagttcgcgtctaaaacacctgatgcaggcgctacccgagacagattggaccgcccatctccgcccgccctttaccgcccccccgaacgactatttatttacaccgaccaccacgggctatgccagtgtggcgaacccctctttgtatactcacctccaatccaccctctcgttcttctccgcgtctgctcccgccccccatcatatatgaataagactaactgacgttctactatcccccctgccccttccagttactcttttcattcccacctacacatggattccttcccatggccatcactaccccccgcctgcccagtcaatcaagatcctccgtcttccactccgactgaaagcgagcagcacgaccatattatgactcccagcttgcacctagctcgtaataaagccaccgcccaccgtacatataccccaatttcgccgtacgcccgcttgaatattcttaccgtgcacctgactctatgtccctctcgggttcgtcgcgtggtcccgccgcgggccctaattctctatcgataatccattgtttacacccgcgcctccacaaagttgtagtcgcttcctactgtcgtccgcgaatacgggtcaccctatacattgtcaacgccccgcattgctatctccccccgccaac

SEQ ID NO: 317119 - DNA, 288 bp, Homo sapiens
caagtaattgaaatgggggttccttatgtctggtaacactttgtttgacagtgtgttagacagaataaggcaagtgttgcatcttgtttagttttagcttctttatgcctgaccaacctaatacagtgttgagtagttaaggaaattcctttggactgattgatataattgtgtttttcactttttttattaagatccccgtcgaggtcaagatcaagatccaggtctatttcacgaccaagaagcagggtagggtaaaaatttgattatgcttttctagttatatgg

SEQ ID NO: 317120 - DNA, 2356 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317121 - DNA, 2154 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaatgacagaaaactctcgatggtctgttcttagctttctacattagtgaccaggataccatgatgct

SEQ ID NO: 317122 - DNA, 3369 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaaggtaagctaaatgttttgttgccaaatcttgcctgtcaagtgtggcctctgcagaatttgtttgcttactgctttgcagtctttgagctctttggagaattggtgctatatagattaaaatactatgctaagtttctgaaatactttttttttttgattcagtaacattagtttatacttttgctggaaatacttagtcataaaatgttagggtgattattaagatgtgattggtcctgtgagtacttggtagaaattttggtaagatagatgccttttccccacatgtacaatagatacaaagtgtggagaaaagtcttggaaatagttacctgcctagtgcttctttatgaccagaaaacttcaaatagttgtcatatttatctagtgcttcttaatgaccagaagacttcaaatagttgtcatatttaactgcaggttgaccttgcaattttgacaaggaggatagcctaatttttttttttttctgggatggagttttcgctctgtccccaggcttggagtgcagtggctcaatcttggctcactgcagcctccgattcccgggttcaagcaattatcctgtctcagcctcttgagcagttgggattacaggcacccaccgccaagcctggctaattttttgtatttctagtagagacggagtttcaccatgttggcgaggttggtcttaaactcctgatcttaggtgatcacctgcctcggcctctcccaaagtgctggggttacaggcgtgagccaccgtgcctggccagggtagcctaatcttaagccagggacaaaagatgaatatatgtaagtttcatgtcatttttaggtctttgctataggaaattagtaccttaggccacctttgaagttattgaaagttagtacatgtacatgagagtttcaattgacactaattggatccaaacctaatgtttttctttttagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317123 - DNA, 3290 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcagaggtatttattttaataaaggaatggttggtattctagttaatcaagtaattcttttattagcaaggcagaaactagtgtttttctataaacttgaatgttaattgtacaggtgtattttacaatttttgtttaattaaaaaaatgttactatattaataatcaacctggtcaaaacctttcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtttattttaaatacacattacagtgttttatattatgtaatgctaagttgtaattcagcttttaacaaatctttttttaggtagtaaaaaaaaaaatactcaacaactaataggcccagagtttatttccaaatgagacactaaatttaaatagttttgagatttgatttcagcagaggcacacaaactcttaaaaacgagttattgtctgacattttgttttttctctaacttgaaaaataggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317124 - DNA, 2377 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317125 - DNA, 3106 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtttattttaaatacacattacagtgttttatattatgtaatgctaagttgtaattcagcttttaacaaatctttttttaggtagtaaaaaaaaaaatactcaacaactaataggcccagagtttatttccaaatgagacactaaatttaaatagttttgagatttgatttcagcagaggcacacaaactcttaaaaacgagttattgtctgacattttgttttttctctaacttgaaaaataggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317126 - DNA, 3254 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcagaggtatttattttaataaaggaatggttggtattctagttaatcaagtaattcttttattagcaaggcagaaactagtgtttttctataaacttgaatgttaattgtacaggtgtattttacaatttttgtttaattaaaaaaatgttactatattaataatcaacctggtcaaaacctttcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtttattttaaatacacattacagtgttttatattatgtaatgctaagttgtaattcagcttttaacaaatctttttttaggtagtaaaaaaaaaaatactcaacaactaataggcccagagtttatttccaaatgagacactaaatttaaatagttttgagatttgatttcagcagaggcacacaaactcttaaaaacgagttattgtctgacattttgttttttctctaacttgaaaaataggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317127 - DNA, 3235 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaggtatttattttaataaaggaatggttggtattctagttaatcaagtaattcttttattagcaaggcagaaactagtgtttttctataaacttgaatgttaattgtacaggtgtattttacaatttttgtttaattaaaaaaatgttactatattaataatcaacctggtcaaaacctttcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtttattttaaatacacattacagtgttttatattatgtaatgctaagttgtaattcagcttttaacaaatctttttttaggtagtaaaaaaaaaaatactcaacaactaataggcccagagtttatttccaaatgagacactaaatttaaatagttttgagatttgatttcagcagaggcacacaaactcttaaaaacgagttattgtctgacattttgttttttctctaacttgaaaaataggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317128 - DNA, 2791 bp, Homo sapiens
ctactactactaaattcgcggccgcgtcgacaggtatttattttaataaaggaatggttggtattctagttaatcaagtaattcttttattagcaaggcagaaactagtgtttttctataaacttgaatgttaattgtacaggtgtattttacaatttttgtttaattaaaaaaatgttactatattaataatcaacctggtcaaaacctttcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtttattttaaatacacattacagtgttttatattatgtaatgctaagttgtaattcagcttttaacaaatctttttttaggtagtaaaaaaaaaaatactcaacaactaataggcccagagtttatttccaaatgagacactaaatttaaatagttttgagatttgatttcagcagaggcacacaaactcttaaaaacgagttattgtctgacattttgttttttctctaacttgaaaaataggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317129 - DNA, 1734 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcagaggtatttattttaataaaggaatggttggtattctagttaatcaagtaattcttttattagcaaggcagaaactagtgtttttctataaacttgaatgttaattgtacaggtgtattttacaatttttgtttaattaaaaaaatgttactatattaataatcaacctggtcaaaacctttcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactaga

SEQ ID NO: 317130 - DNA, 2571 bp, Homo sapiens
gcgcatttcctcagcgctttcccgccacttcagcggacagatctggccgcagctaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317131 - DNA, 1914 bp, Homo sapiens
ctactactactaaattcgcggccgcgtcgacgtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317132 - DNA, 2624 bp, Homo sapiens
aatagaatttctcatgttttgacagccgatcaaagtccagatctccatctccaaaaagaaggtaagctaaatgttttgttgccaaatcttgcctgtcaagtgtggcctctgcagaatttgtttgcttactgctttgcagtctttgagctctttggagaattggtgctatatagattaaaatactatgctaagtttctgaaatactttttttttttgattcagtaacattagtttatacttttgctggaaatacttagtcataaaatgttagggtgattattaagatgtgattggtcctgtgagtacttggtagaaattttggtaagatagatgccttttccccacatgtacaatagatacaaagtgtggagaaaagtcttggaaatagttacctgcctagtgcttctttatgaccagaaaacttcaaatagttgtcatatttatctagtgcttcttaatgaccagaagacttcaaatagttgtcatatttaactgcaggttgaccttgcaattttgacaaggaggatagcctaatttttttttttttctgggatggagttttcgctctgtccccaggcttggagtgcagtggctcaatcttggctcactgcagcctccgattcccgggttcaagcaattatcctgtctcagcctcttgagcagttgggattacaggcacccaccgccaagcctggctaattttttgtatttctagtagagacggagtttcaccatgttggcgaggttggtcttaaactcctgatcttaggtgatcacctgcctcggcctctcccaaagtgctggggttacaggcgtgagccaccgtgcctggccagggtagcctaatcttaagccagggacaaaagatgaatatatgtaagtttcatgtcatttttaggtctttgctataggaaattagtaccttaggccacctttgaagttattgaaagttagtacatgtacatgagagtttcaattgacactaattggatccaaacctaatgtttttctttttagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317133 - DNA, 2057 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaaggtaagctaaatgttttgttgccaaatcttgcctgtcaagtgtggcctctgcagaatttgtttgcttactgctttgcagtctttgagctctttggagaattggtgctatatagattaaaatactatgctaagtttctgaaatactttttttttttgattcagtaacattagtttatacttttgctggaaatacttagtcataaaatgttagggtgattattaagatgtgattggtcctgtgagtacttggtagaaattttggtaagatagatgccttttccccacatgtacaatagatacaaagtgtggagaaaagtcttggaaatagttacctgcctagtgcttctttatgaccagaaaacttcaaatagttgtcatatttatctagtgcttcttaatgaccagaagacttcaaatagttgtcatatttaactgcaggttgaccttgcaattttgacaaggaggatagcctaatttttttttttttctgggatggagttttcgctctgtccccaggcttggagtgcagtggctcaatcttggctcactgcagcctccgattcccgggttcaagcaattatcctgtctcagcctcttgagcagttgggattacaggcacccaccgccaagcctggctaattttttgtatttctagtagagacggagtttcaccatgttggcgaggttggtcttaaactcctgatcttaggtgatcacctgcctcggcctctcccaaagtgctggggttacaggcgtgagccaccgtgcctggccagggtagcctaatcttaagccagggacaaaagatgaatatatgtaagtttcatgtcatttttaggtctttgctataggaaattagtaccttaggccacctttgaagttattgaaagttagtacatgtacatgagagtttcaattgacactaattggatccaaacctaatgtttttctttttagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactaga

SEQ ID NO: 317134 - DNA, 1065 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactaga

SEQ ID NO: 317135 - DNA, 1076 bp, Homo sapiens
attcggcacgaggcggcacgagggttagctaatccgtttgaagttggtgttagtaggtattgtatgatcagtggtgaagcaagtaggaccactgatgtgtctaaatgagcatgacaggaactaaacgaaactgattaaatgtatgagaaatagaaactgatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317136 - DNA, 1942 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcagaggtatttattttaataaaggaatggttggtattctagttaatcaagtaattcttttattagcaaggcagaaactagtgtttttctataaacttgaatgttaattgtacaggtgtattttacaatttttgtttaattaaaaaaatgttactatattaataatcaacctggtcaaaacctttcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtttattttaaatacacattacagtgttttatattatgtaatgctaagttgtaattcagcttttaacaaatctttttttaggtagtaaaaaaaaaaatactcaacaactaataggcccagagtttatttccaaatgagacactaaatttaaatagttttgagatttgatttcagcagaggcacacaaactcttaaaaacgagttattgtctgacattttgttttttctctaacttgaaaaataggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactaga

SEQ ID NO: 317137 - DNA, 913 bp, Homo sapiens
agtgttgctctggctgtctagaggatccctataggcgctaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataaaaaaaaaaaataattt

SEQ ID NO: 317138 - DNA, 1102 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagcgatcaaagtcccagattctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactaga

SEQ ID NO: 317139 - DNA, 1509 bp, Homo sapiens
  misc_feature (1484)..(1484): n is a, c, g, or t
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcagaggtatttattttaataaaggaatggttggtattctagttaatcaagtaattcttttattagcaaggcagaaactagtgtttttctataaacttgaatgttaattgtacaggtgtattttacaatttttgtttaattaaaaaaatgttactatattaataatcaacctggtcaaaacctttcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagcgatcaaagtcccagattctccatctccaaaaagaagtcggtcccccaatcagggaaggtcccccgcaggaaggtgcaaanttcccggaaaaggatttggacttga

SEQ ID NO: 317140 - DNA, 954 bp, Homo sapiens
agcggccgcatatataaacgcgaacccgggctgttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaagtgatttgtcgctcacgcacaggagcagggacgaaggtcaaggtcagcatctcctcgacgatcaagatctatctctcttcgtagatcaagatcagcttcactcagaagatctaggtctggttctataaaaggatcgaggtatttccacctcctgagtagctgggactgccattgtgtaccacagtgcccagctgagggatctgtgccttaagtgagatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactaga

SEQ ID NO: 317141 - DNA, 680 bp, Homo sapiens
ccaggttccgccccacgcctcggtgtatcctaccacgcgtttctgcttgtgttcgggagggtcaccccgcattatttagaacgttaagaattttgtcaaaagtctagtttctcagggatttgcggactttcaccagttttacgactaagttttgtcttggatagagggcattaaatgtgctttacccaatcttgaggatggcccgttttaaggcaaataagtaattgaaacttgggccagattttgcgtaacgtgcattcttctatttgcgtttttaaacagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaagtaagtaagatgttatgaatcttctgttcattaaaatatactgtggctagataatgaacttagtgctaaatttggattctgaagtctggaagagaccttaaatagctggtcatagtgttaaatgctaaaggcacacgaaggttaaagaagatagcggagatggagttagggcttggtaaagaccgccaaagtttgttgggggggaaggagtggttgg

SEQ ID NO: 317142 - DNA, 2553 bp, Homo sapiens
  misc_feature (1250)..(1250): n is a, c, g, or t
catcagtcaggaggccgtgcagtccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccaaacctctggggtatccagcagtggccaaagcgtcagctccaaccagcgtccctgtagttcggacatccccgactctccctgcagtggagggcccatcgtctcgcactctggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctatcctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcgttccagccagtggggactggtggggtccagctctgtggaggcggctccacgggctccaagggaccctgctctccctccagttctcgagtccccagcagttctagcatttccagcagcnccggttcaccctaccatccctgcggcagtgcttcccagagcccctgctccccaccaggcaccggctccttcagcagcagctccagttcccaatcgagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagtcaactgttgtgtgtgtgcatgccttgggcacaaacaagcacatacactatatcccatatgggagaaggccagtgcccaggcatagggttagctcagtttccctccttcccaaaagagtggttctgctttctctactaccctaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcaccttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggctttcgctcccaattccaccccaccctccattacagagctcaccacgccctcctagatcaccgtccccaacacacccattgcctctcaaggcccttatctcagccccttcctgtggccatttccctcagtgcccagatgattccctgggtgagggagacactggggcaccctcagaggttggagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgtccctcattttccttcaaaagcgggctgtgtttctcttctaccttccagctcctcccacagaggaggaagacaataaatatttgttgaactgaaagca

SEQ ID NO: 317143 - DNA, 901 bp, Homo sapiens
tggtctttgaagctgctgcgctctcacctcaccctgcaaggcaggctcttttctgggctggcagtgcctgtgtgatgggcctcctctcctatgacttactccaggctcactgcccggcaccttctggagcacaccaaagccgaatccctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcaccttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggctttcgctcccaattccaccccaccctccattacagagctcaccacgccctcctagatcaccgtccccaacacacccattgcctctcaaggcccttatctcagccccttcctgtggccatttccctcagtgcccagatgattccctgggtgagggagacactggggcaccctcagaggttggagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgtccctcattttccttcaaaagcgggctgtgtttctcttctaccttccagctcctcccacagaggaggaagacaataaatatttgttgaactgaaagca

SEQ ID NO: 317144 - DNA, 366 bp, Homo sapiens
ttaaattcgcggccgcgtcgactttttccacacatagattgacgtttccctgagctctttattcaattccattagtctatctgtttattattttatgtataccataatgtattcaaatatagaataaacagtttaggggatggataagaatcaataatattttccatctttcaaaacaatataaatacatctataaattggacaatagatcaaatgtttactccataacggacagggatctcaagaatccatgataggtaagaatatttcttaaactatcctggagcctatacataatgactacagagtctttttatcagacaactgataaaagaaagagagacagtgactattagaaatgtgttt

SEQ ID NO: 317145 - DNA, 1199 bp, Homo sapiens
gtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagtttta

SEQ ID NO: 317146 - DNA, 662 bp, Homo sapiens
accggcccttgattgggcacagaaattgtgagcagacagtagtagtgatataataaaagaaggcaatcaaaatttaattttatcatgccctctcacaggtttgtgttataattgtaagcccatattacttgtgttagtagttttgtctataggtaacataatgacagtagtgtaaagtttctgttcaagaaacatatgttgtaaagttactttatacaagatacctgccaaaggaaatggtcttactttcaaatgactttgaaagcatgtataattgcaaacagagcaggagttgaaatgggcacagaaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttctgtgcccatttcaaatattttgcatatcgcacctgcgtcgagaggctggaaggctgacgcacccagcaacgtagtgtttatccctccgacataaccaagcaagctctgctatacagattggacttctgcggccatcacgatcattgtcgcggaaatttctgtgcccattacaaggt

SEQ ID NO: 317147 - DNA, 2599 bp, Homo sapiens
gtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagttttaccagattgtcctgtacaacttctaagatcgggatctgtgtgtttctacagaagttctagttttcaaatatagattgtaaggagccttcaattttctttagcgactactacctcagcaacaggaggcagcaaggggctgttcctgtggtggtttctgtttgcatttttgcaggagccataggaaactactgaaatgattgtgctgggtaaattaaggatctggcatcatacaaaatgaagccagaccactaatgcattacagtagttcttgaatacaaggtacaacaactgtttgaaaatatgggtagtttgcccaaaacaggaaaatttgtcttgggtgtaaaaactaaagaaaaaaggcattattcctagatctctcagtgaaatgaaaatggcctcttaagtgaacgtttttattgctaaaatataaaatgctagttagttattaattattaatcttcaaaaaattaaaaatttcccagcctttgtcttctacctctgaggattcagtaagtacatccaataataatgatactgttttatcaatcaacatatttttcatcatccaattacctgacataatttggcacaggatacaaattctgtgcatcagagaaagtaaacactaaaatgactgcgtgacctcattcagtcatgtttttacactttgaacctctatttatttccttttgaaaattagctaatgatggtacattaacgcagctcacttagggctcaatcctaatcacagcttcaaattttagaagaacatataggccaagtttgccatcctcaatttgtccaacaaaattctatttatggtatttagtaaagaaacatttgtctgagaagaaatggttttacatcatctatcctgatagtttcaaacagaataaaggtaactagcatgtgaaataaaaatattcttcttaaaaggtttgtccttctaagcattttaaattcttcactggcttgaaatgtgcctactacagaaatatgcatacagaagcttttgtgtgaactgcagaatcttatacattttgattccttgatgaagtatatactctaaaatacagtcttctaccaaaatttcattcaagttatttaaaagggggagaaaaaaggagaatttaggaaataacctgaactatggatagaaactgaagaagttctctactccaatggaaagtttccttactttatcgtggtaactagttatgtatggtccaggtatgggaagaagcaagttagtaaatcggttttcacctaagaagtttatgactctgaagatcttatatccaccttttctctgcctttgggcagttctgtctgccaacttctagatagccagctcctgtatctgctataaacacatatgtgatccactgcttgtcattttcc

SEQ ID NO: 317148 - DNA, 1429 bp, Homo sapiens
gtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagttttaaaacacaaaacaaaaaaccaacaataaaaacaacacgcgtgggtgcgggacgcactgcgggagaccccctggagaaaaagctttttcgaagcaccacttgcggtgtgggggcgccgcggggggcccccatggtgggttacagtggaacagttggctacagagagtggttccccaagggagaacaccggtcgcaggcaaaagaggcgtgggaattccaccgcaaaaaaaag

SEQ ID NO: 317149 - DNA, 1313 bp, Homo sapiens
gtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttctgtgcccatttcaatgaaatgggcacagaaatatcccatgtatttcccccacacaggcacagcatccctcatcatcagcatcccccaccagagtggtatgtaagttacagttaatgagccgacattgacacatcatcacctaaagtccatagttaacactaaggttctctctaggtgaagtacatgctgtgggttagga

SEQ ID NO: 317150 - DNA, 2141 bp, Homo sapiens
accggcccttgattgggcacagaaattgtgagcagacagtagtagtgatataataaaagaaggcaatcaaaatttaattttatcatgccctctcacaggtttgtgttataattgtaagcccatattacttgtgttagtagttttgtctataggtaacataatgacagtagtgtaaagtttctgttcaagaaacatatgttgtaaagttactttatacaagatacctgccaaaggaaatggtcttactttcaaatgactttgaaagcatgtataattgcaaacagagcaggagttgaaatgggcacagaaattgccttccttgacctccctgaaatctcattatctatctcagacaactgaggaatgcaaccacacctggatggacctgttacaagatagtgcctgcctctcaggctcattcgaatttcaaagagaatcatttacaagttaatttctgtgcccttgaaatgggcacagaaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagttttaccagattgtcctgtacaacttctaagatcgggatctgtgtgtttctacagaagttctagttttcaaatatagattgtaaggagccttcaattttctttagcgactactacctcagcaacaggaggcagcaaggggctgttcctgtggtggtttctgtttgcatttttgcaggagccataggaaactactgaaatgattgtgctgggtaaattaaggatctggcatcatacaaaatgaagccagaccactaatgcattacagtagttcttgaatacaaggtacaacaactgtttgaaaatatgggtagtttgcccaaaacaggaaaatttgtcttgggtgtaaaaactaaagaaaaaaggcattattcctagatctctcagtgaaatgaaaatggcctcttaagtgaacgtttttattgctaaaatataaaatgctagttagttattaattattaatcttcaaaaaattaaaaatttcccagcctttgtcttctacctctgaggattcagtaagtacatccaataataatgatactgttttatcaatcaacatatttttcatcatccaattacctgacataatttggcacaggatacaaattctgtgcatcagagaaagtaaacactaaaatgactgcgtgacctcattcagtcatgtttttacactttgaacctctatttatttccttttgaaaattagctaatgatggtacattaacgcagctcacttagggctcaatcctaatcacagcttcaaattttagaagaacatataggccaagtttgccatcctcaatttgtccaacaaaattctatttatggtatttagtaaagaaacatttgtctgagaagaaatggttttacatcatctatcctgatagtttcaaacagaataaaggtaactagcatgtgaaataaaaatattcttcttaaaaggtttgtccttctaagcattttaaattcttcactggcttgaaatgtgcctactacagaaatatgcatacagaagcttttgtgtgaactgcagaatcttatacattttgattccttgatgaagtatatactctaaaatacagtcttctaccaaaatttcattcaagttatttaaaagggggagaaaaaaggagaatttaggaaataacctgaactatggatagaaactgaagaagttctctactccaatggaaagtttccttactttatcgtggtaactagttatgtatggtccaggtatgggaagaagcaagttagtaaatcggttttcacctaagaagtttatgactctgaagatcttatatccaccttttctctgcctttgggcagttctgtctgccaacttctagatagccagctcctgtatctgctataaacacatatgtgatccactgcttgtcattttcc

SEQ ID NO: 317151 - DNA, 1971 bp, Homo sapiens
accggcccttgattgggcacagaaattgtgagcagacagtagtagtgatataataaaagaaggcaatcaaaatttaattttatcatgccctctcacaggtttgtgttataattgtaagcccatattacttgtgttagtagttttgtctataggtaacataatgacagtagtgtaaagtttctgttcaagaaacatatgttgtaaagttactttatacaagatacctgccaaaggaaatggtcttactttcaaatgactttgaaagcatgtataattgcaaacagagcaggagttgaaatgggcacagaaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagttttaccagattgtcctgtacaacttctaagatcgggatctgtgtgtttctacagaagttctagttttcaaatatagattgtaaggagccttcaattttctttagcgactactacctcagcaacaggaggcagcaaggggctgttcctgtggtggtttctgtttgcatttttgcaggagccataggaaactactgaaatgattgtgctgggtaaattaaggatctggcatcatacaaaatgaagccagaccactaatgcattacagtagttcttgaatacaaggtacaacaactgtttgaaaatatgggtagtttgcccaaaacaggaaaatttgtcttgggtgtaaaaactaaagaaaaaaggcattattcctagatctctcagtgaaatgaaaatggcctcttaagtgaacgtttttattgctaaaatataaaatgctagttagttattaattattaatcttcaaaaaattaaaaatttcccagcctttgtcttctacctctgaggattcagtaagtacatccaataataatgatactgttttatcaatcaacatatttttcatcatccaattacctgacataatttggcacaggatacaaattctgtgcatcagagaaagtaaacactaaaatgactgcgtgacctcattcagtcatgtttttacactttgaacctctatttatttccttttgaaaattagctaatgatggtacattaacgcagctcacttagggctcaatcctaatcacagcttcaaattttagaagaacatataggccaagtttgccatcctcaatttgtccaacaaaattctatttatggtatttagtaaagaaacatttgtctgagaagaaatggttttacatcatctatcctgatagtttcaaacagaataaaggtaactagcatgtgaaataaaaatattcttcttaaaaggtttgtccttctaagcattttaaattcttcactggcttgaaatgtgcctactacagaaatatgcatacagaagcttttgtgtgaactgcagaatcttatacattttgattccttgatgaagtatatactctaaaatacagtcttctaccaaaatttcattcaagttatttaaaagggggagaaaaaaggagaatttaggaaataacctgaactatggatagaaactgaagaagttctctactccaatggaaagtttccttactttatcgtggtaactagttatgtatggtccaggtatgggaagaagcaagttagtaaatcggttttcacctaagaagtttatgactctgaagatcttatatccaccttttctctgcctttgggcagttctgtctgccaacttctagatagccagctcctgtatctgctataaacacatatgtgatccactgcttgtcattttcc

SEQ ID NO: 317152 - DNA, 378 bp, Homo sapiens
ggctcttctctgtttctaatattgataaagaacttctactactatgttagtaacgttattctaaaggaaaggtgcaagggaaagagttaacaggtcttagtgtaacattttgtcatttatttcaatctctcatgggagcttcattaagctttttataacaggaaggctgagggaattcaggaaaaatgaaaaattgcatagctacaagaaaatataaaagagtaacccgacagaatagaaagaacacagagctggtagtaagtagacttcattaagaatcctggattaggccaggcacggtggttcaggagtgtaatcccagcactttgggaggccgaggtgggtggattacctgaggttgggagttcaagaccagcc

SEQ ID NO: 317153 - DNA, 2365 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctccaaaaaaaaaaaggggccccaaagaacc

SEQ ID NO: 317154 - DNA, 2285 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 317155 - DNA, 1721 bp, Homo sapiens
  misc_feature (24)..(24): n is a, c, g, or t
  misc_feature (35)..(35): n is a, c, g, or t
  misc_feature (41)..(41): n is a, c, g, or t
aaggtgtccttgtgggttaacccngcccccttccnggttancgggatattaaaatagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 317156 - DNA, 2953 bp, Homo sapiens
  misc_feature (2341)..(2342): n is a, c, g, or t
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctccaannaaaaaaaaaaaacaaaaaaaaaaaaaaaaacaacacacaacaaaaaaaaaaacaaaaaaaaaaacaaaaaacaccgacaccaaaacacaagcggggggcaccacacacaacaacccggaagcggcgccacaatcaacacaccaccataccaaacaagagccccaaaagagggcgcaaacaacacacaagaggggcacgcaaactacaaaagaggcaggagaggacaacagacacgcggacaacaggagcgaccacccacccccgcgggcggcgacacaaccaccccatcacccacaccccacgacagccccgcgaggcaacacaccacaccccaagcaaacgaggcggcacaccacggagaaacaccaccgcaaaaactcagcagccccacggaaccgccatgacacgcccacacaacgcgcgggggcgaccagcaccgacacaacaggcacggcacgacgagcaggcgaacacagagcgagccgcacgcgacgcggcgcaggaacagacacgaagcgcggacagagagacgggcagacagcagcgagcagcacgggacagcggcagaacgcaggagacgaagcgcgcagcgagaagaacaacgtgaacaa

SEQ ID NO: 317157 - DNA, 1728 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 317158 - DNA, 2304 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 317159 - DNA, 1903 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctagtctgggtctcttaaacgccaccctcagtttataccaactgatcaggaaatacgctggtgacaggcccttgaatgggtacatgccggcttcccgtaagttgattagatgggaaaccaaacaccgtctttcaagtgtgaggctgtgcc

SEQ ID NO: 317160 - DNA, 1425 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgcctctagtcagttttctaatcctcggggcaccg

SEQ ID NO: 317161 - DNA, 1208 bp, Homo sapiens
  misc_feature (1192)..(1192): n is a, c, g, or t
  misc_feature (1204)..(1204): n is a, c, g, or t
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtcgccaggagttatgcagttcgggatgttgtaaaggnatggcaagagcnacag

SEQ ID NO: 317162 - DNA, 1209 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggactgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 317163 - DNA, 483 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccaggtgggatgatgctagcgactcttgagcatgttttccaaaaaccctattcggttaaacattaacatttgttctctgttctatgattctgataactcctgggctatgtggggccctgttctgtgtattt

SEQ ID NO: 317164 - DNA, 2339 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 317165 - DNA, 2320 bp, Homo sapiens
ccaggtctggtacaccccgagttatggatatgtcgacccagcgcgcctcgcgtgtgcccctacggcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 317166 - DNA, 1950 bp, Homo sapiens
cgctagtagaggctggtgtgtaatcggcgaggctaaccactgtgttcatctctggggtcatcgcccggggtgacaaagatttccccccggcggctgcgcaggtggctcaccagaagccgcatgcctccatggacaagcatcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 317167 - DNA, 2036 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 317168 - DNA, 2204 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgcgtgagaattcagagcatcttaagtctcaagcctccagcaaggaggcgcataccaaagtcgcgcctctatggactcagcacatg

SEQ ID NO: 317169 - DNA, 2307 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccacacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 317170 - DNA, 1841 bp, Homo sapiens
  misc_feature (1767)..(1767): n is a, c, g, or t
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctagcttccctaanaaatcatggcattcacacagcccataaaagcaagacagtttaccaaagaggtttttgccacatttgattatata

SEQ ID NO: 317171 - DNA, 1303 bp, Homo sapiens
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaatgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 317172 - DNA, 867 bp, Homo sapiens
  misc_feature (786)..(786): n is a, c, g, or t
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgccatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccatgtcttcgcctcccnaagggaaactagagactaaagctggacacccgcccgccgtgaaagctggtggaatgcgaattgtgcagatccgctatccgt

SEQ ID NO: 317173 - DNA, 573 bp, Homo sapiens
ctcacatacataccccatgcttcctgcagggacgctggtgggcgctggcctggggcttcctcacccacaaacaccatgcttcctgcagggacactggtgggtgctggcctgggggttcctcacccacaaacaccatgcttcctgcagggacactggtgggtgctggcctgggggttcctcacccacaaacaccatgcttcctgcagggacgttgatgggcgctggcctggacgttcctcacatacaaccgccatgcttcctgcagggacgctggtgggcgctggcctggggcttcctcacatacaaaccccatgcttcctgcaggggcgctggtgggccctggcctggggcttcctcacatacaaaccccatgcttcctacagggacgctggtggatgctggcctgaggcttcctcacacacaattgctatccttccgcagggacgctggtgggcactggcctggggcttcctcacccacaaaccccatgcttcctattgattaacctgagctttccgtgtttcctgacagggtgacaaagatttccccccggcggctgcgcaggtggctcac

SEQ ID NO: 317174 - DNA, 5577 bp, Homo sapiens
  misc_feature (4215)..(4215): n is a, c, g, or t
aggcgcactgccgtcgggcgggcctagcgggcgcggtcattgtcctggcagagcggcgagccggtgagtgtggctgcggggtcgcgcccaccctctacctgtgccgggggccggaacctggccccggggagggcgcggcctcggggagacggcgtgcaggcccagcactgttggtcaccgcaggcctgtcttcctattcaccgtgggcagcagagggatggctgctcagctgctgactgatgaggcactggaatcagtgacgttcagggatgtgactgtggacttcacccaggaggagtggcagcagctggagcctgcccagaaggacctgtacagggatgtcatgctggagaactacaggaacctggtctcactggactgggagactagacctgaaatgaaagagttggatccaaagaatgacatttcggaagacaagctctccgttgttggggaggccacggggggacccacgaggaatggtgccaggggtcctggctcagaaggagtgtgggaaccaggcagctggccagagaggccgcggggagatgcaggtgcagagtgggagccattgggaattccccaggggaacaaactcttagggggctcagtacccgcatgtcatgaactgaaggcatttgccaaccaaggctgtgtcctggtcccaccacggctggacgaccccacagaaaagggggcctgtccacccgtaaggcgtggcaagaacttctccagcacttcagacctcagtaagccccccatgccctgcgaggagaagaaaacctacgactgcagcgagtgtggcaaggcctttagccgaagctcgtccctgataaagcaccaaaggatccacacgggagaaaagccgtttgagtgtgacacctgtgggaagcacttcatcgagcgctcgtccctcaccatccaccagcgggtgcacacgggcgagaagccctatgcctgcggggactgcggcaaggccttcagccagcgcatgaacctcactgtgcaccagcgcacgcacacgggcgagaagccgtatgtgtgcgacgtgtgtggcaaggccttccggaagacttcctctctcacccagcacgagcggatccacacgggggagaagccctacgcgtgcggggactgcggcaaggccttcagccagaacatgcacctcatcgtgcaccagcgcacgcacaccggggagaagccgtacgtgtgccccgagtgcgggcgagccttcagccagaacatgcacctgaccgagcaccagcgcacgcacaccggggagaagccgtacgcctgcaaggagtgcggcaaggccttcaacaagagctcctcgctcaccctgcaccagaggaaccacaccggcgagaagccctacgtgtgcggcgagtgcggcaaggccttcagccagagctcctacctcatccagcaccagcgcttccacatcggcgtgaagccgttcgagtgcagcgagtgcggcaaggccttcagcaagaactcctcgctcacgcagcaccagcgcatccacaccggcgagaagccctacgagtgctacatctgcaagaagcacttcacggggcgctcgtccctcatcgtgcaccagatcgtgcacaccggggagaagccctacgtgtgcggcgagtgcggcaaggccttcagccagagcgcctacctcatcgagcaccagcggatccacaccggcgagaagccgtacaggtgcggccagtgcgggaagtccttcatcaagaactcctccctcactgtgcaccagcggatccacacgggcgagaagccctaccgatgcggcgagtgcgggaagaccttcagccgcaacacgaacctgacgcgccacctgcggattcacacctgagcgcctctgtgcagggctctcactggcggtgcccaggacggacgccagatggctgcgcgctttgtcagcagtgctgtgagaagttctcccctggggtggggactcggggtcaggggagctcaggaatgtggtgttgtggaggggctggctgatcacacatgccccctccttactgagcctcagaaagcaagcccctcggtgtctgacgtatctggggacacttcaaggttcactgtagctgagccatggccgctggtaacagacatcagggttccagactagccctcttgagtaactgtcctagagctgggacaggtcacgcctgcctccacatctctgtttcttcagcgggaaagtggagctggtggaggggagggaggagacatctccctctttgtcagatacatcctggagtccagatgcagcttgtcaccatctgcattttctccgtgggttgggagcgtgagggccttcctatccctccacccaccgtttccctgcagtgcacgctggcagccaccaagctaggaagtggcaggagtttgccggttgtttgtgaggggaaaaatttttttttcagagttagcaaataacagtaactactgctttgaatgccaaagtttcttagagtggtctgttacgttttttaaaaataaaacttttaattaagggagactatgttattttaaacagtcttctgttttggccagttgtctggtcaaaatcggcttcagtgattgtgggaggggcaagaaggaaaagaaacagcagcaggtttgatattcagaaagaaatatgcatggattcaataagtatatacatctgagcacagattatttttatagtgatttttgcagctaaatgtgaaggcaactgtcttaagtcccttcctgctgctgtaacaaaagaccttagactgggtaatttataaacaatagaaatttgtcactcatggttctggatgctgggaagtccaagatcaaggctctggcagatttggtgtctgatggggtatgttcttcataggtagtgcttgtgtcttgatgtgtgtcttcacgtggttgtaaacagcagacttcctcaggccccttataagggtgctaatcccagtcacaagggccctgacctcatgacctcccaaaggtcctccctcttcatactgttacattggggatcaagtttccaatatgtgaatacagggaagcaccaacagaccatatcagtaacttcgagtgagtttcctaaggccgactgaagctctgtttacacataagagtgttccccaaagtgcactttctctggggccttttaggccatacttttaattttgttatttgatactactggttgctaatgttctggcatttccagttgttccacactccctgacactggtgtacacaaataaataatacagaaaaaaattatatcagcaagcacattctgcaaataagaaaaacagccactcgggcacgtataaacaaggtggaccgtttttcaaattctggcagtcaagtgggcctcagggtgggtttgattcaggctctcatcattggagccatagctgtggttctctgtgatgctctggctctcccttcatacttcttaacatcatcctcaggctggcttcccacgtgggattgtggtggtttccagcagcgagtcttgatcagacattgctttagttgcatctgttgtgggaataaatgagaatatgtatgcactgcagagaatggagtgttaaaacagtcaacaaatgttagctaatatgtacacaagattttactactctttagcagcaaaatggaggggaagaccttctaaggccctttggagagatgaaatggctcatttaaccctcacaagatcctcgaggtagggattcatgtgcatgtcgtatagataaggaatctgaggttcagtgaggcaaggtaagcttcctgagggcacacaacatggaagtggaggggacagggtgtgagctggggtccacctgggctccgaggtccgtgctccttgcctacactggactacttctagagatggacatattgaatttctcaggacttgactcctggccttggtttcctggactccccagtgtgtgaagcagagatgggatcgaggctgcaccaccaccatccccctctcccatccagagaaccagccgggccacctctcaggtccctcctgtttcttttctctgcaacccaagctgatgtggagggcattgaggctcctctggggggatgctgtggtaccaggtgggtctcacatccctggtctcccgcctcctgggcaagctccccactcagggctccacgtttccccaagaggaaccctgaggnggctggaataatggccacattgacggagtcacttgtccaactctgagggggcgctctcatcacccccactctacagatggggaaacaggctcgcagaggttcaggcacctgcccaaggtcacacagctgctggattcaaacccattctgactccagaagctggactgcagtccacggcaccactccacccaccagttcctcagtcaggtacttactgaagccaaattaaatttacccccctgaaaatgtgggtttggcagggatcaagcaggtcaggaacctgctttttaacaagtcttctatcccatacatctgtccaaggcactatttggggttatgtgctggccttcgagttcaccctcactgggccctgtgtccctgtgtccctgtgtccccaggcctgacccaagcctggccttgaggtagaggtcatgggtgctgggtggggtctgaatgacccctttatcacttggagtaaatgccaaactcctcacaaacccctgtgtgacgcagcctctcccagctcccgtcccgctccccctgctcactctgcttcagccacactgtgctttcgttcagtcccagcgctggcccagcccactcccaccgcaggggcctctcccttcctggcccagcacccacgctgagcttcctcaggtccctgatgctcagtttcacgtgtcggcctggctgggctccagtgcccagcaggcccatcgcagtgagtcccggtggtgctgagaagacactttatagatgtggatgtcacccatgtcagctgactttaagtaaacgattattatctgcaatgtgtgtgggcctcatctaatcagttgaaggccttaagagcaaaaccagtttcttggagagtaaaaaactctgcctcaggattacagtgccaactccggcctgagtttccagcctaccagcctaccttatggatttgggacttgccagctcccacagtagcatgacccggttatttaaattaaatctatttatatataaaagtatacatatgccatatgtataacaagaaatatgaggtatataaaaggatatgtataagatatatatagggtagggcatggtgacccacacctgtaatcccagcactttgggaggccaaggtgggaggattacttgagaccaggagtttgagaccagcctaggcaacatagcaagacctcatctttacaaaacgttagaaaaattagccaggtgtggtggcgtgtgcctgtggtcccagctactcaagagacggaggtgggaggattgcccgagtccaggaattagaggttgcagtgaggtatgatcatgccattgcactccagcctgggtgacaagggaagactctctctt

SEQ ID NO: 317175 - DNA, 5450 bp, Homo sapiens
  misc_feature (4088)..(4088): n is a, c, g, or t
aggcgcactgccgtcgggcgggcctagcgggcgcggtcattgtcctggcagagcggcgagccggtgagtgtggctgcggggtcgcgcccaccctctacctgtgccgggggccggaacctggccccggggagggcgcggcctcggggagacggcgtgcaggcccagcactgttggtcaccgcaggcctgtcttcctattcaccgtgggcagcagagggatggctgctcagctgctgactgatgaggcactgactgggagactagacctgaaatgaaagagttggatccaaagaatgacatttcggaagacaagctctccgttgttggggaggccacggggggacccacgaggaatggtgccaggggtcctggctcagaaggagtgtgggaaccaggcagctggccagagaggccgcggggagatgcaggtgcagagtgggagccattgggaattccccaggggaacaaactcttagggggctcagtacccgcatgtcatgaactgaaggcatttgccaaccaaggctgtgtcctggtcccaccacggctggacgaccccacagaaaagggggcctgtccacccgtaaggcgtggcaagaacttctccagcacttcagacctcagtaagccccccatgccctgcgaggagaagaaaacctacgactgcagcgagtgtggcaaggcctttagccgaagctcgtccctgataaagcaccaaaggatccacacgggagaaaagccgtttgagtgtgacacctgtgggaagcacttcatcgagcgctcgtccctcaccatccaccagcgggtgcacacgggcgagaagccctatgcctgcggggactgcggcaaggccttcagccagcgcatgaacctcactgtgcaccagcgcacgcacacgggcgagaagccgtatgtgtgcgacgtgtgtggcaaggccttccggaagacttcctctctcacccagcacgagcggatccacacgggggagaagccctacgcgtgcggggactgcggcaaggccttcagccagaacatgcacctcatcgtgcaccagcgcacgcacaccggggagaagccgtacgtgtgccccgagtgcgggcgagccttcagccagaacatgcacctgaccgagcaccagcgcacgcacaccggggagaagccgtacgcctgcaaggagtgcggcaaggccttcaacaagagctcctcgctcaccctgcaccagaggaaccacaccggcgagaagccctacgtgtgcggcgagtgcggcaaggccttcagccagagctcctacctcatccagcaccagcgcttccacatcggcgtgaagccgttcgagtgcagcgagtgcggcaaggccttcagcaagaactcctcgctcacgcagcaccagcgcatccacaccggcgagaagccctacgagtgctacatctgcaagaagcacttcacggggcgctcgtccctcatcgtgcaccagatcgtgcacaccggggagaagccctacgtgtgcggcgagtgcggcaaggccttcagccagagcgcctacctcatcgagcaccagcggatccacaccggcgagaagccgtacaggtgcggccagtgcgggaagtccttcatcaagaactcctccctcactgtgcaccagcggatccacacgggcgagaagccctaccgatgcggcgagtgcgggaagaccttcagccgcaacacgaacctgacgcgccacctgcggattcacacctgagcgcctctgtgcagggctctcactggcggtgcccaggacggacgccagatggctgcgcgctttgtcagcagtgctgtgagaagttctcccctggggtggggactcggggtcaggggagctcaggaatgtggtgttgtggaggggctggctgatcacacatgccccctccttactgagcctcagaaagcaagcccctcggtgtctgacgtatctggggacacttcaaggttcactgtagctgagccatggccgctggtaacagacatcagggttccagactagccctcttgagtaactgtcctagagctgggacaggtcacgcctgcctccacatctctgtttcttcagcgggaaagtggagctggtggaggggagggaggagacatctccctctttgtcagatacatcctggagtccagatgcagcttgtcaccatctgcattttctccgtgggttgggagcgtgagggccttcctatccctccacccaccgtttccctgcagtgcacgctggcagccaccaagctaggaagtggcaggagtttgccggttgtttgtgaggggaaaaatttttttttcagagttagcaaataacagtaactactgctttgaatgccaaagtttcttagagtggtctgttacgttttttaaaaataaaacttttaattaagggagactatgttattttaaacagtcttctgttttggccagttgtctggtcaaaatcggcttcagtgattgtgggaggggcaagaaggaaaagaaacagcagcaggtttgatattcagaaagaaatatgcatggattcaataagtatatacatctgagcacagattatttttatagtgatttttgcagctaaatgtgaaggcaactgtcttaagtcccttcctgctgctgtaacaaaagaccttagactgggtaatttataaacaatagaaatttgtcactcatggttctggatgctgggaagtccaagatcaaggctctggcagatttggtgtctgatggggtatgttcttcataggtagtgcttgtgtcttgatgtgtgtcttcacgtggttgtaaacagcagacttcctcaggccccttataagggtgctaatcccagtcacaagggccctgacctcatgacctcccaaaggtcctccctcttcatactgttacattggggatcaagtttccaatatgtgaatacagggaagcaccaacagaccatatcagtaacttcgagtgagtttcctaaggccgactgaagctctgtttacacataagagtgttccccaaagtgcactttctctggggccttttaggccatacttttaattttgttatttgatactactggttgctaatgttctggcatttccagttgttccacactccctgacactggtgtacacaaataaataatacagaaaaaaattatatcagcaagcacattctgcaaataagaaaaacagccactcgggcacgtataaacaaggtggaccgtttttcaaattctggcagtcaagtgggcctcagggtgggtttgattcaggctctcatcattggagccatagctgtggttctctgtgatgctctggctctcccttcatacttcttaacatcatcctcaggctggcttcccacgtgggattgtggtggtttccagcagcgagtcttgatcagacattgctttagttgcatctgttgtgggaataaatgagaatatgtatgcactgcagagaatggagtgttaaaacagtcaacaaatgttagctaatatgtacacaagattttactactctttagcagcaaaatggaggggaagaccttctaaggccctttggagagatgaaatggctcatttaaccctcacaagatcctcgaggtagggattcatgtgcatgtcgtatagataaggaatctgaggttcagtgaggcaaggtaagcttcctgagggcacacaacatggaagtggaggggacagggtgtgagctggggtccacctgggctccgaggtccgtgctccttgcctacactggactacttctagagatggacatattgaatttctcaggacttgactcctggccttggtttcctggactccccagtgtgtgaagcagagatgggatcgaggctgcaccaccaccatccccctctcccatccagagaaccagccgggccacctctcaggtccctcctgtttcttttctctgcaacccaagctgatgtggagggcattgaggctcctctggggggatgctgtggtaccaggtgggtctcacatccctggtctcccgcctcctgggcaagctccccactcagggctccacgtttccccaagaggaaccctgaggnggctggaataatggccacattgacggagtcacttgtccaactctgagggggcgctctcatcacccccactctacagatggggaaacaggctcgcagaggttcaggcacctgcccaaggtcacacagctgctggattcaaacccattctgactccagaagctggactgcagtccacggcaccactccacccaccagttcctcagtcaggtacttactgaagccaaattaaatttacccccctgaaaatgtgggtttggcagggatcaagcaggtcaggaacctgctttttaacaagtcttctatcccatacatctgtccaaggcactatttggggttatgtgctggccttcgagttcaccctcactgggccctgtgtccctgtgtccctgtgtccccaggcctgacccaagcctggccttgaggtagaggtcatgggtgctgggtggggtctgaatgacccctttatcacttggagtaaatgccaaactcctcacaaacccctgtgtgacgcagcctctcccagctcccgtcccgctccccctgctcactctgcttcagccacactgtgctttcgttcagtcccagcgctggcccagcccactcccaccgcaggggcctctcccttcctggcccagcacccacgctgagcttcctcaggtccctgatgctcagtttcacgtgtcggcctggctgggctccagtgcccagcaggcccatcgcagtgagtcccggtggtgctgagaagacactttatagatgtggatgtcacccatgtcagctgactttaagtaaacgattattatctgcaatgtgtgtgggcctcatctaatcagttgaaggccttaagagcaaaaccagtttcttggagagtaaaaaactctgcctcaggattacagtgccaactccggcctgagtttccagcctaccagcctaccttatggatttgggacttgccagctcccacagtagcatgacccggttatttaaattaaatctatttatatataaaagtatacatatgccatatgtataacaagaaatatgaggtatataaaaggatatgtataagatatatatagggtagggcatggtgacccacacctgtaatcccagcactttgggaggccaaggtgggaggattacttgagaccaggagtttgagaccagcctaggcaacatagcaagacctcatctttacaaaacgttagaaaaattagccaggtgtggtggcgtgtgcctgtggtcccagctactcaagagacggaggtgggaggattgcccgagtccaggaattagaggttgcagtgaggtatgatcatgccattgcactccagcctgggtgacaagggaagactctctctt

SEQ ID NO: 317176 - DNA, 170 bp, Homo sapiens
ctggtaaattccacccagtggacatgaagtgaaagggacccacatacaggggatgccccaaggggtctgggggctttcccagccccgacaataggtctgagcgtcagcatctcccaggccaatggctgggaactgtgttcatttcctgagctctaccaatcttcttccca

SEQ ID NO: 317177 - DNA, 260 bp, Homo sapiens
cattgcacttgagcctgggcaacaagagcgaaactccgtctcaaaacaaacaaacaaacaaacaaaaaattattctctggaaattctgggtaacgtcagtggattacatcaatgttaatcttctggttgtggtattatatactacaatcaccagctgaggtaaccaggtgaaaggtacacaagatctctcaattttatttcttgtaactacatatgaatctaaagtctatctaattaaaagagaaaaagattttcagaaa

SEQ ID NO: 317178 - DNA, 284 bp, Homo sapiens
caattctcccacctcctactcaagcctcttgagtagctgggattacaggcgcatgccactatgcccatctctacaaaaaaaaattttttttaattagccgagcatgctggtatgtagctgtagtcctagccactcaggaggctgaggcagaaagatcacctgagcccaggagtttgatgttacacagagccatgattgtggtactgcacagtgtgggctatggaccaggaccctgtttcttaaagcaaaatattatcaattaaattcatcataatcatcttagt

SEQ ID NO: 317179 - DNA, 638 bp, Homo sapiens
  misc_feature (76)..(76): n is a, c, g, or t
tcacactcaaatgctaacccgtcacggcttctgaccacaccgtcttggaccttaaccccagtgatctctcttaatnctccaccgctacagtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317180 - DNA, 2850 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaactgagcatttgtctaaatattagtttgccctttctttgaatgaagacaatgtacacataggcgacaggctctgccagtagactaccagcatttctttgtgatccttttaagagattgatataaatgtcagtcagttctctgccttgctttattaaattagcacttgccattttttcatctgattgccttactacttctagaagtgaggccctcactcctggtgctgattttcaaaacttcctaaggaccagagactgcaaatgcagattttggcaatccctttcctgctgtgtctctatgtgggtgtactgttggtggctgactcccctggaggtcaccctgaagcttcctggttggcc

SEQ ID NO: 317181 - DNA, 602 bp, Homo sapiens
  misc_feature (33)..(33): n is a, c, g, or t
tttttattttgtatttttgttgtttttcatctnttttttgcatcccggtgacagtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317182 - DNA, 4331 bp, Homo sapiens
  misc_feature (2043)..(2043): n is a, c, g, or t
gaatatacttgtctgtgcgtattttccatcagtgtttataacatcttgatgttattgtctctcagtgcagaaggctttctcattatcttgcatcttttcctaaccatcttgttacatcagaaagactacatagtgcctttaagaaaagccaacgttttcagtcatgaatataacattttctgtcactgaaaaaatggaattttaaatactattttgcccaaaatgaacactgaaccccattgtcttaacttactgatacgtagtgcagccgctcttggagggctgtgggaagctgcaacagccatctgctgccatctactggcgcctgtccacatgtcacctcctccatcccctgggtctgcccagctcatgggattttccttgatagggataagtttgtaggtggtgaagggaatacaagtaaaattctcagttttctttataacgttttgagatgtttttcttaaagatacaggatgatacttatcaatgattaattttaataactggaatagcccttatttcaagaactttctgaaatagctcaatatatgacagaaacaaatatattttgatgtgtgcagcaattgagaaccatttgaatttaaggctcttactgtaatttgaatttaaaagctaaaaattgatttagaatgaatgctacttttgaggaaaatttcatttaaactcatttatggtttggttttgtttttcccttaagttacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtaagggctgtgtgtgtctctctgcaggacatgctggtctccaacttccccttccaaagcgacggctaacggcacagcacgattcggctctttgcagttcttacttaaccgacgccccctaaacagcaaaatcgattgcgtgtgttgtcgacctgtttcacgtttgcattacgttggtgccaggaccctcagcgcttcccctcccaaatgatctgggagtggagcagaaagaaggccagatgcattccatcattttgcaaatgcagtgttttgggaagtactttccttaaaagtgctgcttactctctagtatgctgtgctcaaagcatccattgaagtcatgccagggaataatactccgatgaggaactttttgcatgattcctggaacaaatgtctaattgggaagaagagttgaggaaaggttaattctgcaatctgtacagtaccagagcacttccattacttggtaaataaaatgtagcatcacagtttgaagtttttcatcttgatcttgtgacattaaagcacaaatcaaagctatattatttcctcgagataacttacatggatgaattgataggatgcacacattttcttagaacatggatagaaatctctactgatgagcagcaaaagtgaaaagaaaacaatttaggaggcaaccagatttccaggtacacttaaatacttgcatttttattcatgtgcaggaaaatagcatccggacatgactgtctctcatggatgaggtggtgattccgttttgtatctcaggtcactgggacttacattttagtgcctcctgatttctcaatagtacagataaaatatctgcttaacattgaggaaaaaatcaggtagttggcattggcttctagaaaagtatttgcaataaatgtgaatattaagaaaacatgatcagttttagttgtttgaatgaccagccctgaaactaatatgcgaagttagaaaaccgacttaacagctgctttacctggtgatacagaaatagaactgtccactttttcagaaaggcataaaagaggctacgtggctgtgaattgttgtttgctgtgaaagcattgatactcctggaagaaagccctctttaagactgtctaatgcccacgtgttaaggatttgggagaggccataagaaaaattacgtgtgtgtgtntgtgtgtgtgtgtaatgtgtgtaaaattcaggggaggacatcttccttctccagagttagggtcgtaagaggatagtctcgtggccttgacattaagaatcgttcacttgcacgtgacattatcagagctgtcagtggaatcttctagtgactagatatgtaggttcgtaaacaatataagggttttgttttgtttttttcatttttcttaagttttttttctggaaggcatctatctagtctgtatactgccagcctgagctttccactcctaattgtgtggctttaattataaaatcgtgtgtgtgtgtgtgtgtgtgtgtgtgtgtgtgtgtgtgtgtgtttcaagtaagtgttttccttaaatccttttctaacacctgaatccaaaccggagtggagggagggcgggcagggatgagggagaccactcctgcctcaagcctggagggcaagagggtgagactgcagccctggcccctcacacggccctcaaggaggttgctcagaggcagtaaacggggcgctcccaaggccagatcagcgcagccttctggtttctttaacagctgctggctcctgatctgactttcccacataccgaaagggtttggcctttgtacgttccatttcctggttaataattgaatgtagaaaagcaaggcatttcgtaaatgggaacaatgtgatatcagtccttggttcattgatgtagctcagatattaaaaacacccaccaataattaaatgtgtgtactcattaagaatggtttgagaactgttaaaaatatgttacggcagagcaacggggcctatattttatgcattcctttaaattcagagtacctggggggcacgcgtagtgaacaggctcaggacctcgggatctgtcagctccctcctaagttctgtttgcgggggctgctcaggtggggcgtatacttgcttttatttgtcttttttggtacttgcagaacttcctttcatattctgtgccattgtgttttgatgaaacagccttttctcttgaattactgcttgtgaaaaatgtcccaaaccactaataccgaaacccaatgcagcctgagaagtttcatcgtcggctcttagcgcaacttctatagttaaattctgcttagtgtaattaaaacacaagaagcttccttggaccagaggcacgtcacttacttgaggccattgtgaggaaacactacctgtcacgttgaaattttgcggttttaagtgattttaacaccgcggggcgtgttgtgttttcctccgcactaacaatagccgggcgaggttccccttttatgggtgggaagataatggagtcagtctccttggtgtattttcaaggaaaataaggaccctaaaacaactaagggccttacaagtattctgtttttctttgaaatgttactttttatcgtttaaattccagtaatctatcatgtttctgtttagcttagctgaagtaaaacttgaccaatcgtagaatggtgggcctggcaataagttctaaaaaaagtgtcacataaatcgtaatgaacaaatctgttttgtgaagtaaacaatttgaacacagtttaaaaacctcaggaagaagagatgtggggtggccgttgagaagtagtgaatccgctcggggcgcttggtgtggcagggccttgtgcactgattcatttgaaacactcagcctgccctaaacacagaagctgtgttttatttgaagggcttctgtagggttcacacagcaaaagttcctaataactttttcagtgtctgttatatactatttaacattaaatgtggcaggtcacattttaaatgattgtgtaatagtttttccgaacacgtggagagaggatgttaatacacagtaaaatgcaggtaagcaaacaaatcaataagaaagtacagtggattattaaggtccagaatcagtaatataatttaggaaacaactgatagaataaattttagtgcctttttatatgccttctgaaaatgtttctgcagtaactcatttcagtttgaaaactcgttttcttagactcgtaacactattgtaaactgggagcacttctgtaatcaaagttagcatgactcagctgtttcaaacttctacctttatgatactcttgaacagaaatgttagaaatatatatattttcagaataacggtagaatacatttttccacatgtcaaattagacttatagctgctgaatttattgcataattttcactttgactttgaagtcaaataaagtcatgatgagcac

SEQ ID NO: 317183 - DNA, 1850 bp, Homo sapiens
tcagttgtcaacaaaatcagtaagtgttattaaataccccatggtgtgtggttctggcactgaaatggggctgtttcctaaggctctgtccatggccacctctgtctatttctgcattctgtcttgcattgcttctgttgcctatatcctggtcagcacagtttatggtgaatcattgcttattgaaatagagacggcaataatgaagccagctattataaattagagcaaatatacacatccaatacgttttaaacgcatgtgatctctggagtagtatcactaggtagcttccatttcagttcgcctttggtatattactgtactccaaagaatatcatttttccctctgtaaaattttcctcatgaaaatggtcaccataggtctgatttactttttggatcagtaacaggtcacagcataaatcccattcctgcatcaaggcggaacaagaccctcacactttggagggagctgagttcctgtttagaagaacatgcacagttagataaatctgttcacacggcttagatgatcagagccaacatctgatgactatgagcaaggcacttttctaaacatttttagtattttctgaacagttttgttgaggtatactttacagataacattcacctcttgagctgcagttcaatgagttctcgtaaactgagttgtgcagccatcaccacgttccagttttagcacatttccatcaccccaaaagttcctttctgcctgtttgcagccaatccctgctccctggccagccacaggcaagcgctgtcaatgtttggacagtgttggattacctaatggactcttcaagacagtcctttggggtgttactgtcattctctgttttacacggtgaagaagtgaggcactgagggcactcagggtggtttcaaatgaccgaggccaggtgctcagggcccagaaccctcttaccccctccaacttcagtgagcttcaaaatcacctgctgagcttgtttgaccacagacttgtgggctccacccttgaattcctgacgccctaggtctgggatggggcttgacaatttgcatttgtaaaaagttcctgaatgctgctgctgctgctggtcagggaaccctgctttaagacctcctggtttatgcaatttcaaacattgtaagaaatagtcactcatgtgattggtttgtgtgcttggtgtagactgtacgaggatttttcaaaagtaagtattgttcattctaaaggaaggaaatgtatgttatgagatagaattatataataaacagaaccattaaatgccatctgaaaagtggtgttttcaatggcaggaagtagcattgctgcgtattttgtgtgtgtgcgcaactcagctttgtgtcattgtgtaactttaatttgaaagaacatcacgtgactgctgttttcatttctgccttttaaaaagcagacagctattcagaacagcaagaagcagacccaaactttgtttgtatgcccctagtcataggcaaaaatggaaagggtaatttaccaaaaaagaagaaaatagataaaaaggaaaagaatggaaagaaagtactgactcactgcaaacagctgcaaaatgttgcccttgggatagaggttaactcggttgtgaaataatggccaaagcggtgcactcttaataacttttttgtagccctggagaaagcttctggattgactgtgagaagcttggcagaaggtgctgcggcctggtggctggctcagcaggaggcctgggattgaaagctctcggtttgtacaagctcttttggatttgtaacacttttattttaaatctccaataaatgtaaatattttggtc

SEQ ID NO: 317184 - DNA, 413 bp, Homo sapiens
agaaatggattaggagcctgccgcctcttggttctggttactaattcttactctcccctccccctgcatttttcaaaattcaaggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317185 - DNA, 520 bp, Homo sapiens
  misc_feature (490)..(490): n is a, c, g, or t
tatttcgaccctctcacttcctttcttattcgtatatacccatttatctagtcagctcaggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaactagatgcggcaagatttcgcacantgggaaacaaaaatataaggtaacaagcga

SEQ ID NO: 317186 - DNA, 531 bp, Homo sapiens
acagggggtgggaattaagttgcaatggactatcttattgaaccacatatacaggtatgtagaaggtcaaggaaatctgtgtgaatagaagccatgaggaggcagggagagtaggacagatgggcaaaaaggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaactgatgaaggcgagccgagtgatatgatttgggcgtggatcattgcgaagatgatgggcgtcaagcta

SEQ ID NO: 317187 - DNA, 902 bp, Homo sapiens
taacttagtagatcagataaaaagtaaggaaaaagggctattggcaagcctctgttaatttacaccgctacatacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcgcatatagtcaagaaatttagatgattgaagcctagaaaaagcataatatttttttagtctgtgaaaattggcacggaaaaatcacgcgcactgacaaactgagaacacattatgaaaaaaggaatcagcaactacaactggaatgaatggattataaccatatatatatataccaaaataaatgatacgtaaaacatgataagatggaaacacaaatagaatgaagcatttagagaggaactgaaattagaacaaaatcatctcactaggtagtatggttgtacaagagagtctgattattattatgcacgtagattaccatttgaatatttttttggttatatgtatctcatgtttataaagtaatcctaaatgatgtagtttagtgtcatggcagccttgtgatacaaaagaatgttgatataaacagtatatctataattatggataaatttttattattttatatattactattggtatattaatgatgataaatatgtagcttaagttattgttctatgactaacatggtataagttagaataatattttagaagtaatatttgatatagattgtaaaatataaagagaattactagataagtcatatgattagactatcatctaaatatttacaccctgtcacgccgttatagtaataaatgacaggataaaatatattaagg

SEQ ID NO: 317188 - DNA, 586 bp, Homo sapiens
gggatttcaggaaagaacattctctaggcgcttctgaggcattggatgaatatggccacagtggtgtgaggggccaggagccccatgccaggacacccacccacaccacatagccattgccctaggaacctggacttgcccgtttcaaagactgggaggccaaagacagcatggttttcagctgcagctcactcctgcagggaagcctcgcgcttaacgccagtgggcttaacccagctcagcctggctgcccctcaggatgaaaggcaagttctgaacgcagtctgagcaaaggcccgtgggcgctcccagtctcctagcatggaatgcatgtagctctggaagtcattcctgtgtctggagggttttccggaagctgccttgtgccttgttgtgggtactcgctgtgtcttgcagaggatgggacagtggtcctcgtggcgccagggccgagctgttcccagttccccgggactatagacagaaatatgtatatttggtggtggttttttttttttggtaacagctatactgagatgtaattcacatacaatttagccctttaacgtgtacgattcggtggttt

SEQ ID NO: 317189 - DNA, 2493 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317190 - DNA, 2415 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317191 - DNA, 2439 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317192 - DNA, 2090 bp, Homo sapiens
ggtagtgcttcctgccagctcatttcaactgctttgagtttcttaatataataatgatgaggtagaatttacattccacttatggtattaattttacatttctctgaatgaaaagggttagaaggtagtaaaattgaacattaaatgaatcggaggagacagtagtgcaatatatgactgccctaaagacattgtgcaatgcctcatgggattaatgttgagtctcatttcctgcttttacaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317193 - DNA, 1306 bp, Homo sapiens
gggagccgtgtcttcatgcctgtgcctctttcccagagggagactcctgtgggccctggttagccctaccatgggtgcaggagggctgttttctgttcgctgtgccgtggcggtagaccgtccttgtgtccttgaactttgaggtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317194 - DNA, 1168 bp, Homo sapiens
agaacatcagtttatgtcctgaaatatgttttcagaaaatagaaagccaagtatatttcgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaagacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317195 - DNA, 648 bp, Homo sapiens
gtgggttatacctgtcttgcagccatccgagatcacgcttctgtcttgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317196 - DNA, 2541 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggcaacctcgagtctgtctgtagagatctgcctattctggacatttcaggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317197 - DNA, 2352 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317198 - DNA, 2551 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaactcgatgcggccggacccgcggacaagaccaattactatattgtgcgtaaaacgtgcata

SEQ ID NO: 317199 - DNA, 2557 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaactaaaagatagatgggccgaagccctgcctcccccggagtgggcttgctctattgtagctcgaaga

SEQ ID NO: 317200 - DNA, 2552 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaactgagcgatgcggccgagaactggcacgccggggtgggtggcatgtactgggagaccgcaa

SEQ ID NO: 317201 - DNA, 2549 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaacttgcgagcagaccttcactaatctagatcgcaattcgaaatcgcgaaacatttagaa

SEQ ID NO: 317202 - DNA, 2567 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaactgccctgcaggcgggccagaagagactaatattattaaaaataaatccgatatgaccgtgcgtagacagatagcg

SEQ ID NO: 317203 - DNA, 2545 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaacttgcggccgaaatatctcaatataaaaacagcttatcgaaatccggacgacgg

SEQ ID NO: 317204 - DNA, 2544 bp, Homo sapiens
  misc_feature (2502)..(2502): n is a, c, g, or t
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaactgtgatgcgncagtccccctgcgtcttttaagtgtgttgaacttaggcaagc

SEQ ID NO: 317205 - DNA, 2552 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaacttatgatggcggccggaacaaaataattaaaatattaattgttcaagtcggaatgatggg

SEQ ID NO: 317206 - DNA, 2557 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaacttgctgatgcggccggaacacccacccacatctctacacatcttagacctgatccgccttatata

SEQ ID NO: 317207 - DNA, 467 bp, Homo sapiens
tatttcgaccctctcacttcctttcttattcgtatatacccatttatctagtcagctcaggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaaactgaact

SEQ ID NO: 317208 - DNA, 2375 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctcacaaaactgcacactccctcaccccaccgtcccacaacaacctgcctaccgaaccaccccaacctccacgccccaccacacaatctctcctccccacaacacccttttttatacaccgaaactacaatacatcaatcatatttcactcacctcctcctacaccacacaacacaccacccacaccaccccccacgcccttacactccacacccacccaacaccccaaaattacatccccaccggcccaccaccccccccacccccgcacacaccacactccttataatcacccaacgacctcacaca

SEQ ID NO: 317209 - DNA, 2501 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgccctggagaaagcttctggattgactgtgagaagcttggcagaaggtgctgcggcctggtggctggctcagcaggaggcctgggattgaaagctctcggtttgtacaagctcttttggatttgtaacacttttattttaaatctccaataaatgtaaatattttggtccctttttttctctattttttaaaataaaaatattttagtgaatatgagttaaatgagaatcaagtggcttctgggcctccctgaaagatcaagtggaagcactggatgactctaatgatgccgaattgtaatccataaagcacctgggcagagttcaatcagaggtcccatttcagaagttttttggaatgtagggaaagaattacttagaaaaggttcatctacttggagaggagatggttcaatatgacttttagaagaagccgcagtccctgccccacaggggctgcttagattgcttagatggattgtcatctctctctctttttttttttgggacggagtctcgctttgtcgtccaggctggagtgcagtggcatgatctcgg

SEQ ID NO: 317210 - DNA, 2113 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgccctggagaaagcttctggattgactgtgagaagcttggcagaaggtgctgcggcctggtggctggctcagcaggaggcctgggattgaaagctctcggtttgtacaagctcttttggatttgtaacacttttattttaaatctccaataaatgtaaatattttggtc

SEQ ID NO: 317211 - DNA, 1972 bp, Homo sapiens
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactatcaatggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtctttctcgagaagcaggtggaaacatgagcattcagtttcttggtacagtgtacaaggtgaatatcctaaccagacttgccgcagaaatgctttattctggagggtgccgtctcttgtcgcctggg

SEQ ID NO: 317212 - DNA, 1970 bp, Homo sapiens
  misc_feature (1850)..(1851): n is a, c, g, or t
  misc_feature (1855)..(1856): n is a, c, g, or t
  misc_feature (1859)..(1859): n is a, c, g, or t
  misc_feature (1876)..(1876): n is a, c, g, or t
  misc_feature (1878)..(1878): n is a, c, g, or t
  misc_feature (1883)..(1883): n is a, c, g, or t
  misc_feature (1887)..(1887): n is a, c, g, or t
  misc_feature (1894)..(1894): n is a, c, g, or t
  misc_feature (1896)..(1896): n is a, c, g, or t
  misc_feature (1905)..(1905): n is a, c, g, or t
  misc_feature (1919)..(1919): n is a, c, g, or t
  misc_feature (1925)..(1926): n is a, c, g, or t
  misc_feature (1937)..(1938): n is a, c, g, or t
  misc_feature (1941)..(1942): n is a, c, g, or t
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactatcaatggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgcctgttattaaaccagacatagccaactgggagctctcagtaaaattgcatgataaagttcataccgtagtagcatcaaacaatgggtcagtgttctcggtggaagttgatgggtcgaaactaaatgtgaccagcacgtggaacctggcttcgcccttattgtctgtcagcgttgatggcactcagaggactgtccagtgtcttnntcgnnagnaggtggtgagcattagntncttgnacantgtcaangngaatatttnaacagacttggcgnagattnnaccaattattnntgnngtgggccgctttttttctggagacccgg

SEQ ID NO: 317213 - DNA, 1709 bp, Homo sapiens
  misc_feature (1612)..(1612): n is a, c, g, or t
  misc_feature (1626)..(1626): n is a, c, g, or t
  misc_feature (1628)..(1628): n is a, c, g, or t
  misc_feature (1630)..(1630): n is a, c, g, or t
  misc_feature (1695)..(1695): n is a, c, g, or t
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaagcacatgctaaccaagagtaaagaccngttattggcatagntntnttgttgtggcttcagtaagagcacacatttcagaaatcagatgctgtataacagaatgcactggncctagtaaatgctg

SEQ ID NO: 317214 - DNA, 1777 bp, Homo sapiens
  misc_feature (1714)..(1714): n is a, c, g, or t
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagaaaacaaagaatttgccagatgtttggcagcagaagatgtcgttttcattggacctgacacacatgctattcaagccatgggcgacaagattgaaagcaaattattagctaagaaagcagaggttaatacaatccctggctttgatggagtagtcaaggatgcagaagaagctgtcagaattgcaagggaaattggctaccctgtcatgatcaaggcctcagcaggtggtggtgggaaaggcatgcgcattgcttgggatgatgaagagaccagggatggttttagattgtcatctcaagaagctgcttctagttttggcgatgatagactactaatagaaaaatttattgataatcctcgtcatatagaaatccaggttctaggtgataaacatgggaatgctttatggcttaatgaaagagagtgctcaattcagagaagaaatcagaaggtggtggaggaagcaccaagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggacccctacaagtcttttggtttaccatctattgggagattgtctcagtaccaagaaccgttacatctacctggtgtccgagtggacagtggcatccaaccaggaagtgatattagcatttattatgatcctatgatttcaaaactaatcacatatggctctgatagaactgaggcactgaagagaatggcagatgcactggataactatgttattcgaggtgttacacataatattgcattacttcgagaggtgataatcaactcacgctttgtaaaaggagacatcagcactaaatttctctccgatgtgtatcctgatggcttcaaaggacacatgctaaccaagagtgagaagaaccagttattggcaatagcatcatcattgtttgtggcattccagttaagagcacaacattttcaagaaaattcaagaatgctgttattaaccagacatagntcaactggagctctcagtattgtggaaggtgatgggtcgaaacttgtgccagccgtggcctgg

SEQ ID NO: 317215 - DNA, 653 bp, Homo sapiens
  misc_feature (653)..(653): n is a, c, g, or t
ccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaatcttggttcagtgggatatgatcctaatgaaaaaacttttgataaaattcttgttgctaatagaggagaaattgcatgtcgggttattagaacttgcaagaagatgggcattaagacagttgccatccacagtgatgttgatgctagttctgttcatgtgaaaatggcggatgaggctgtctgtgttggcccagctcccaccagtaaaagctacctcaacatggatgccatcatggaagccattaagaaaaccagggcccaagctgtacatccaggttatggattcctttcagctgacacacatgctattcaagccatgggcgacaagattgaaagcaaattattagctaagaaagcagaggttaatacaatccctggctttgatggagtagtcaaggatgcagaagaagctgtcagaattgcaagggttggctaccctgtcatgatcggcctcagcn

SEQ ID NO: 317216 - DNA, 3661 bp, Homo sapiens
  misc_feature (1373)..(1373): n is a, c, g, or t
cctcagtcactttttccagcataaatttgttcgattctgcggcaagtctggttaagatattcaccttgtacactgtaccaagaaactgaatgctcatgtttccacctgcttctcgagaaagacactggacagtgttctgcgttccccgatgcccggagtggtggtggccgtctctgtcaagcctggagacgcggtaagggctgtgtgtgtctctctgcaggacatgctggtctccaacttccccttccaaagcgacggctaacggcacagcacgattcggctctttgcagttcttacttaaccgacgccccctaaacagcaaaatcgattgcgtgtgttgtcgacctgtttcacgtttgcattacgttggtgccaggaccctcagcgcttcccctcccaaatgatctgggagtggagcagaaagaaggccagatgcattccatcattttgcaaatgcagtgttttgggaagtactttccttaaaagtgctgcttactctctagtatgctgtgctcaaagcatccattgaagtcatgccagggaataatactccgatgaggaactttttgcatgattcctggaacaaatgtctaattgggaagaagagttgaggaaaggttaattctgcaatctgtacagtaccagagcacttccattacttggtaaataaaatgtagcatcacagtttgaagtttttcatcttgatcttgtgacattaaagcacaaatcaaagctatattatttcctcgagataacttacatggatgaattgataggatgcacacattttcttagaacatggatagaaatctctactgatgagcagcaaaagtgaaaagaaaacaatttaggaggcaaccagatttccaggtacacttaaatacttgcatttttattcatgtgcaggaaaatagcatccggacatgactgtctctcatggatgaggtggtgattccgttttgtatctcaggtcactgggacttacattttagtgcctcctgatttctcaatagtacagataaaatatctgcttaacattgaggaaaaaatcaggtagttggcattggcttctagaaaagtatttgcaataaatgtgaatattaagaaaacatgatcagttttagttgtttgaatgaccagccctgaaactaatatgcgaagttagaaaaccgacttaacagctgctttacctggtgatacagaaatagaactgtccactttttcagaaaggcataaaagaggctacgtggctgtgaattgttgtttgctgtgaaagcattgatactcctggaagaaagccctctttaagactgtctaatgcccacgtgttaaggatttgggagaggccataagaaaaattacgtgtgtgtgtntgtgtgtgtgtgtaatgtgtgtaaaattcaggggaggacatcttccttctccagagttagggtcgtaagaggatagtctcgtggccttgacattaagaatcgttcacttgcacgtgacattatcagagctgtcagtggaatcttctagtgactagatatgtaggttcgtaaacaatataagggttttgttttgtttttttcatttttcttaagttttttttctggaaggcatctatctagtctgtatactgccagcctgagctttccactcctaattgtgtggctttaattataaaatcgtgtgtgtgtgtgtgtgtgtgtgtgtgtgtgtgtgtgtgtgtgtttcaagtaagtgttttccttaaatccttttctaacacctgaatccaaaccggagtggagggagggcgggcagggatgagggagaccactcctgcctcaagcctggagggcaagagggtgagactgcagccctggcccctcacacggccctcaaggaggttgctcagaggcagtaaacggggcgctcccaaggccagatcagcgcagccttctggtttctttaacagctgctggctcctgatctgactttcccacataccgaaagggtttggcctttgtacgttccatttcctggttaataattgaatgtagaaaagcaaggcatttcgtaaatgggaacaatgtgatatcagtccttggttcattgatgtagctcagatattaaaaacacccaccaataattaaatgtgtgtactcattaagaatggtttgagaactgttaaaaatatgttacggcagagcaacggggcctatattttatgcattcctttaaattcagagtacctggggggcacgcgtagtgaacaggctcaggacctcgggatctgtcagctccctcctaagttctgtttgcgggggctgctcaggtggggcgtatacttgcttttatttgtcttttttggtacttgcagaacttcctttcatattctgtgccattgtgttttgatgaaacagccttttctcttgaattactgcttgtgaaaaatgtcccaaaccactaataccgaaacccaatgcagcctgagaagtttcatcgtcggctcttagcgcaacttctatagttaaattctgcttagtgtaattaaaacacaagaagcttccttggaccagaggcacgtcacttacttgaggccattgtgaggaaacactacctgtcacgttgaaattttgcggttttaagtgattttaacaccgcggggcgtgttgtgttttcctccgcactaacaatagccgggcgaggttccccttttatgggtgggaagataatggagtcagtctccttggtgtattttcaaggaaaataaggaccctaaaacaactaagggccttacaagtattctgtttttctttgaaatgttactttttatcgtttaaattccagtaatctatcatgtttctgtttagcttagctgaagtaaaacttgaccaatcgtagaatggtgggcctggcaataagttctaaaaaaagtgtcacataaatcgtaatgaacaaatctgttttgtgaagtaaacaatttgaacacagtttaaaaacctcaggaagaagagatgtggggtggccgttgagaagtagtgaatccgctcggggcgcttggtgtggcagggccttgtgcactgattcatttgaaacactcagcctgccctaaacacagaagctgtgttttatttgaagggcttctgtagggttcacacagcaaaagttcctaataactttttcagtgtctgttatatactatttaacattaaatgtggcaggtcacattttaaatgattgtgtaatagtttttccgaacacgtggagagaggatgttaatacacagtaaaatgcaggtaagcaaacaaatcaataagaaagtacagtggattattaaggtccagaatcagtaatataatttaggaaacaactgatagaataaattttagtgcctttttatatgccttctgaaaatgtttctgcagtaactcatttcagtttgaaaactcgttttcttagactcgtaacactattgtaaactgggagcacttctgtaatcaaagttagcatgactcagctgtttcaaacttctacctttatgatactcttgaacagaaatgttagaaatatatatattttcagaataacggtagaatacatttttccacatgtcaaattagacttatagctgctgaatttattgcataattttcactttgactttgaagtcaaataaagtcatgatgagcac

SEQ ID NO: 317217 - DNA, 553 bp, Homo sapiens
agagttcctgagtttatttgttgcattgttgctttttagtgcatactcaaaaagaaatacgactctataaatgataggcagaacaatcagatttgcaattttgtgtgtatttgcagatgatggtaattctttttgctgggcgcatctgttaatgcagaaatttgtctcctcaggttcatgtgaaaatggcggatgaggctgtctgtgttggcccagctcccaccagtaaaagctacctcaacatggatgccatcatggaagccattaagaaaaccagggcccaagctgtgagtctgaatgaatctatctactgcagctgtttcatatgtagtgagcagaaagctagagtttgtatttaaaaaaaaaaataggaaagaatgattgaaaatgctgttgcagttagttcatgtcacatgagttaaatgtggtcgaattcgctactggaaatcaaaggctttgtagcatctggcagtgttggttgctgatcctgcaggtggctgctggattcagctttcacaccagggagcagtttcagttcatttccaaatttgct

SEQ ID NO: 317218 - DNA, 673 bp, Homo sapiens
tttctccagattatcagaattcaatttttcactgattcattgttctatcaatggataactatgttattcgaggtgttacacataatattgcattacttcgagaggtgataatcaactcacgctttgtaaaaggagacatcagcactaaatttctctccgatgtgtatcctgatggcttcaaaggtttgtatgcattaaaatattttagtgttttaaagttgttatttttatactttattgtaatacataatttcactctattttgaaattaaggccttttggcttatattatacttcatttttagaacatgcaagactgtttacattcatgattttgagtatttatggatgactcatgagtgtgataatctgcagtcttgtggagtgcagaattcaaccatgtgaattgttctatgagtccagtgttttggagcaaaacatgtagatagatcattagcctacctgacttcctggtttctgaaaatcaaatcagatttgtattttctactgaggtgagtatataaggaactcttctaaagtgatttttaagagatatattaatgaaaatagcactgaaaatttcagaaaaccagattctggtcctattaatgaaaatctaggaagatgatgattttattctgaaaaatgaagttttcaataaagtaatgagtgg

SEQ ID NO: 317219 - DNA, 438 bp, Homo sapiens
aagaaaatgtttatgtaatgcacacaaaagataacttgatttttgtccgaaatgtagacaaacatttttttgtatatgtagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggtaacaacaactgttatttattcctctccatgcctctgtactttacccttccttctccacccttttttgttttataaatgttaaaaaattaactccataaagtgttaaataaagatttagtttttatgcttgtgctaagacatctgttaggaatgacggatagtatccctctaaagttcaatgtctagacctctgctttgtcactg

SEQ ID NO: 317220 - DNA, 286 bp, Homo sapiens
ggtaacagctatactgagatgtaattcacatacaatttagccctttaacgtgtacgattcggtggtttcagtcaattcagagttgtgtagttgtcaccacaatcaattttggaacatttttatcactctcaaaagaaaccctgtacccttcagcagtgactccccttccctcttcaaccccaggcaacctcgagtctgtctgtagagatctgcctattctggacatttcaggtaagtggaaaacattccaatttccgaacacctctgttagtggcagagccagact

SEQ ID NO: 317221 - DNA, 351 bp, Homo sapiens
tcataattgatagcattacatttaagtctttagtttgaattgattttcatatatggcaaggcacaggggtctagtataatttttctgaatttaaatatttaaatggccctgcatcatttattgaagaaattagcttttccctaaagtgtgttcttggcaattttgttgacaatcagttggctttaggtgcataaactaacttctgggcttcttgggcacattagtctatgtgtttgtttttatgccagtacagtgctgttttggttactatagctttgtagcaagttttgaagtttgataaagtgatgcctttagctttgcttattttgctcaaagttatttgtctattca

SEQ ID NO: 317222 - DNA, 9802 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacacaaaacacaaacaaacaggcgccgacaaaattccccaggcccattacggaccattctacaagcgcccaaaaaagaataaaaaacggccctaaacgtgtggaagcatggctgaagacctgggtaaggacacaaaccagaaatgctgc

SEQ ID NO: 317223 - DNA, 12763 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacacaaaacacaaacaaacaggcgccgacaaaattccccaggcccattacggaccattctacaagcgcccaaaaaagaataaaaaacggccctaaacgtgtggaagcatggctgaagacctgggtaaggacacaaaccagaaatgctgc

SEQ ID NO: 317224 - DNA, 8801 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaagaaattttgtatatataaccattttaatcttttataaagttttgaatgttcatgtatgaatgctgcagctgtgaagcatacataaataaatgaagtaagccata

SEQ ID NO: 317225 - DNA, 9090 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtttatgctgctaatacgggggatcctcatagacgtcg

SEQ ID NO: 317226 - DNA, 9072 bp, Homo sapiens
  misc_feature (8698)..(8698): n is a, c, g, or t
  misc_feature (8701)..(8701): n is a, c, g, or t
  misc_feature (8705)..(8705): n is a, c, g, or t
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaanaantttnggtttttttcccctttaactttaaaaagggtttgggaagtggtccccgtgtttgtcaatttgcggccgcgtgtgagccatacattaatattaatataagtaaccgccaatccgggttacacttagtgggcgtgtatttcccctaaaaccctgagagataggacattagattggcaaaggtaatttccacgaggtgagcgcttttaatttccctcacccatgtcgggatccctttaactaaacgggcgttgggcccccgataaaaaagtgggcggagaaaaggcgccagcgggttctgacacgcggcgacatttttcgtttccccaggtgtgtgcgctttaaaaggcgatataaaagggggagttcgg

SEQ ID NO: 317227 - DNA, 8715 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcacagacccacaatgaattctgtatacagactctggtt

SEQ ID NO: 317228 - DNA, 8523 bp, Homo sapiens
tcccccttttccacaggggtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacacaaaacacaaacaaacaggcgccgacaaaattccccaggcccattacggaccattctacaagcgcccaaaaaagaataaaaaacggccctaaacgtgtggaagcatggctgaagacctgggtaaggacacaaaccagaaatgctgc

SEQ ID NO: 317229 - DNA, 7501 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacacaaaacacaaacaaacaggcgccgacaaaattccccaggcccattacggaccattctacaagcgcccaaaaaagaataaaaaacggccctaaacgtgtggaagcatggctgaagacctgggtaaggacacaaaccagaaatgctgc

SEQ ID NO: 317230 - DNA, 12907 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaaccgtaagtggtcctttagaaagaatggactaccgtgctataacaactactagacaccttcattttacggctgtggtatcggcagtttagggtatggagcaagtaatattgtgtgttttctttttttctttctttccttccatgtagcatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacacaaaacacaaacaaacaggcgccgacaaaattccccaggcccattacggaccattctacaagcgcccaaaaaagaataaaaaacggccctaaacgtgtggaagcatggctgaagacctgggtaaggacacaaaccagaaatgctgc

SEQ ID NO: 317231 - DNA, 12712 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacacaaaacacaaacaaacaggcgccgacaaaattccccaggcccattacggaccattctacaagcgcccaaaaaagaataaaaaacggccctaaacgtgtggaagcatggctgaagacctgggtaaggacacaaaccagaaatgctgc

SEQ ID NO: 317232 - DNA, 4540 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacacaaaacacaaacaaacaggcgccgacaaaattccccaggcccattacggaccattctacaagcgcccaaaaaagaataaaaaacggccctaaacgtgtggaagcatggctgaagacctgggtaaggacacaaaccagaaatgctgc

SEQ ID NO: 317233 - DNA, 3386 bp, Homo sapiens
ccagctatgggcttcgagcgcatggtggtgatagtcttggactcaaggtccacaggatgatctgcacggaggtcccatgcatttcatctgctccatcagataatataacctgaatcctccatacgacgagtctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccagtttaaaggagtacatttggaacgtgtttttggaaaaagcatgttaatgtagcagaagagacttcagtgcacactttcgaagaaaaacagtttctgagcattaagtggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacacaaaacacaaacaaacaggcgccgacaaaattccccaggcccattacggaccattctacaagcgcccaaaaaagaataaaaaacggccctaaacgtgtggaagcatggctgaagacctgggtaaggacacaaaccagaaatgctgc

SEQ ID NO: 317234 - DNA, 10612 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacacaaaacacaaacaaacaggcgccgacaaaattccccaggcccattacggaccattctacaagcgcccaaaaaagaataaaaaacggccctaaacgtgtggaagcatggctgaagacctgggtaaggacacaaaccagaaatgctgc

SEQ ID NO: 317235 - DNA, 11238 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaattccatgcttactgtgatttaatctgtctataagtaaagtccaagcacttggctattaccaccctctgagcccaaggcttagcatggacgagagaagaaatagcggaacactcaagcctatgggaccagacacggtaccgcgc

SEQ ID NO: 317236 - DNA, 10700 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagttgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattccgtcgctgcactccgggtaccgagct

SEQ ID NO: 317237 - DNA, 8630 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaacagctaccttccaatcagcttatcg

SEQ ID NO: 317238 - DNA, 8139 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgaggccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagagggaaggatcgtagagaggaaggatggtacgagc

SEQ ID NO: 317239 - DNA, 5918 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaaaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaggtatgccagcaaggtccaggtatgccagaaggtccaggtatgccagaaggtaacaggtatgccagaagtcacagt

SEQ ID NO: 317240 - DNA, 675 bp, Homo sapiens
aaacaatatacaaagaataagtataaactcaatgaaaatacacttatccaagcaatattgcaatataaaatatatgcttcaagtggtgtaaaagtgtttgcacttagaaaatatatttaaactgtttgtcctcataaatttatgtcttcggccttcacatttatctcccaggagtgtcggttttatttgtattttaataagaaaattataataaaaacttggggtttcattttaggtgaggtttttgtatttgggtttgtttttctacagtagagtttaatccatgtgttgcttttcttcaagtatagtttaaaggagtacatttggaacgtgtttttggaaaaagcatgttaatgtagcagaagagacttcagtgcacactttcgaagaaaaacagtttctgagcattaagtggtaaaaggcaataataattcaaatgatgataacaagccaacctgctaaaaagaatgcatgttctgtgtatccagccatttcacatgaactaaccccatttaaaagaatacattttccattcactgtgcacatatgtgtaatcatttttgactaaaatcaattgccattatcatgccaactaaatctgcagtagaatatattagttgccagatacagtacaaaaaatatcatttaagagtaatcgtgattgaatcccagaaa

SEQ ID NO: 317241 - DNA, 268 bp, Homo sapiens
gggcagaggcctctctggggtctcttttatgagggcaccaatcccatccatgagaattccactctcctgacctaatcacctcccaaaggccccacatcctaataccatcaccttgggggttaagatttcaacatatgagttgagggggacacagcattgggaccagagcaatcccttcatgaaccctttaaggttcatgagagtagaagctgattcactcacttatctccagtttctatgcctggcacaaaacagggcgaggatcaga

SEQ ID NO: 317242 - DNA, 720 bp, Homo sapiens
ggcttccgtagcgggagggcgaaagatggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaa

SEQ ID NO: 317243 - DNA, 602 bp, Homo sapiens
ggcttccgtagcgggagggcgaaagatggcggcggcagtactgggacagttgggtgcgttatggatacataacctgaggagccgggggaagctggccttggggaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaa

SEQ ID NO: 317244 - DNA, 336 bp, Homo sapiens
tcggttccgtaccttcgaccccccggaggaggggtaccttccgctggaacctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaa

SEQ ID NO: 317245 - DNA, 329 bp, Homo sapiens
cgcgccgttcgtccggccagaggaggagcggctttcattagacctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaa

SEQ ID NO: 317246 - DNA, 329 bp, Homo sapiens
  misc_feature (22)..(22): n is a, c, g, or t
ccatcgcgctccaccccgcganaaagaaaacccttcactgaacctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaa

SEQ ID NO: 317247 - DNA, 435 bp, Homo sapiens
cgaaatctaccaaaatatagcaaagacaagatgtgatatttggcaaaattgatacgaggaatgtctattgaccaggctttggctcagttggaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttggcccccacctccacctgagccaccaaagacggcagttgcccatgccaaagagtatattcagcagcttcgcagccggaccatcgttcattcagactccacagtgtatatattttgccatttattttctaaaaataaacaaaaattgaaggcaaa

SEQ ID NO: 317248 - DNA, 609 bp, Homo sapiens
  misc_feature (21)..(21): n is a, c, g, or t
cattatggccgggggtagcgnaagggcgttttattttggcggcagtactgggacagttgggggcgtgatggatacataacctgaggagccgccccaagctggccttggggaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaa

SEQ ID NO: 317249 - DNA, 768 bp, Homo sapiens
  misc_feature (738)..(738): n is a, c, g, or t
ggcttccgtagcgggagggcgaaagatggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaaaaaaaaaaatggcctcgntggctacagcggtggagctgtgcggcccag

SEQ ID NO: 317250 - DNA, 759 bp, Homo sapiens
ggcttccgtagcgggagggcgaaagatggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaataaaaactgatttaaaaaccaaaaacaaaaaaaaaatag

SEQ ID NO: 317251 - DNA, 781 bp, Homo sapiens
ggcttccgtagcgggagggcgaaagatggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaacgtggttccccagagcccctcctccctccctctttgcgtgttgtgtctatagttggggata

SEQ ID NO: 317252 - DNA, 341 bp, Homo sapiens
cgatatcgaaatttataacaaaactagagcttcacctgacccccctcacgcattgctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaa

SEQ ID NO: 317253 - DNA, 1301 bp, Homo sapiens
ggcttccgtagcgggagggcgaaagatggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatatttcatgatatgtcaaaaatagtcaataaagtcacactaataagatggatgacttaacatacaatttatttgtttattataagagaaaaaagacgatgacaaccgtacacttccttaatcaagtcaagtacaacaagacggactgatgcgcggcagaatgctcgacaacatccgccaccccctcaccacacaccgacccccacaatctcacaagaacaacacccaacgcccagctatgagataaatatcgtgtggctctctctgtgatttgtttgactctcaaatctcgtaaatcgaccaattgcatgtttgaattcagtccagcgcccctactctcatatcctcacaccgcccccactcattcgattataccagacgcatcctacacctaagattcgctcctacttgcatacacgatctccaccgcatatctgtcgctacgcccctcacgtcatccgttccacacgcataaaacgcacttatcctccaaatctcgttcgccaccggtaagacatatcttcgtctattccgatcaaccagcacaatatcgccgcacctacaatatcccggctaccatttagatctatatgaaaatgtaagcaaatactagtcaccactattcgctcagcatagcaacatcaacaatacagcgtttgccgcaggacagcgtccgcagccatcaggatatcatagtag

SEQ ID NO: 317254 - DNA, 1403 bp, Homo sapiens
ggcttccgtagcgggagggcgaaagatggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaaaaaaaaaaaaaaaaaaaaaaaaaaacacaaaaaaaaaaaacaaaaaaaaaacaaacaaaacaaaaaaaaaaaaaaaaaaaacaaaacaacaacaaaaaagagaaaacgaaaccaacaaaaacaacaacaaacaaaaaaaaagaaaaaagagagagggggagaagggcagcgaggagagagaataagagagagagaggagagggcaacaacaacaaagaagacgaaaagcaaacacgctacagacgcacagaaaagaagagccaaacaacgcaaacacagagtagaaaaaagaaagaaaaggagaaaagaggaacgcgcaagacacaacaaaacggcaagcaaaaagaagaaaaaaaagaaaggaaaaggagtaaaggacgaagagaaaagagtagaacagagaaaaggaagaggaagaaggaaagaagagagcacaaagagggaccaagacgagagagagaaacgagagacgcgagaagcagagacgcagcaaagaaagacaaagcgaagaagagaggacaacgagcgagcgaaaggtgcagaaaagagagaaacgaaggagcagggagcaagagggagagggcggaagaccaagagagacaagcgacgaaaagcaggaataaagaacaagacaagaaaagcgggagggggaaggcaaaggcgaacaagagaccaaaaaggaa

SEQ ID NO: 317255 - DNA, 338 bp, Homo sapiens
ctcttgtaacgcccctaacagcctacgcctcgtctctcgactcgaataacacctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaa

SEQ ID NO: 317256 - DNA, 341 bp, Homo sapiens
  misc_feature (51)..(51): n is a, c, g, or t
ttattcccatcgtgcccacgagagaaagagtcctcgttggaccccctcagncttactgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaa

SEQ ID NO: 317257 - DNA, 313 bp, Homo sapiens
  misc_feature (1)..(1): n is a, c, g, or t
nttcccccgtatactgagtcgtatgtgctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaa

SEQ ID NO: 317258 - DNA, 795 bp, Homo sapiens
gactgcacgccgctagagcgggctgtgctttgtaatggtttatttaactcgaaggtaaagaggttaaacactcgattaggagaaatgggaccgggccccccccttgggtgcccgactggatatgtcatatgccaaaggggccttttccagttaattggttcatccatcaggggttagtgcacaccagtttgggacttaatggcagtgaattttatatttccgctcggacaagggatttacgaaatctaccactgtcgaagacaaataaaatatagcaaagacaagatgtggtatttggcaaaattgatacgaggaatgtctattgaccaggctttggctcagttggaattcaatgacaaaaaaggggccaaaataattaaagaggttctcttagaagcacaagatatggcagtgagagaccataacgtggaattcaggtccaatttatatatagctgagtccacctcaggacgaggccagtgcctgaaacgcatccgctaccatggcagaggtcgctttgggatcatggagaaggtttattgccattattttgtgaagttggtggaagggcccccacctccacctgagccaccaaagacggcagttgcccatgccaaagagtatattcagcagcttcgcagccggaccatcgttcacactctatgatgaggagattcagactccacagtgtatatattttgccatttattttctaaaaataaacaaaaattgaaggcaaacgatgcggccgaagccccggtttctctgattttttgggccatgctgattccaata

SEQ ID NO: 317259 - DNA, 312 bp, Homo sapiens
tgctccggatgggggcgcctcctcccaggagcttctctgaaggaaatgggggaaaagctggagcagggtccctggcagtgtccctccgggagggcttcctgcacctggctgtggtccagagcactgctagcagtctgcgtgcatcttccacagagttcctctccgccaggtaacactggggaggctaggggtcagggctgtggctggttgaggtgtgtgatgtggggaggctaggggccagggctgtggctggttgaggtgtgtgatgtggggaggctaggggccagggctgtggctggttgaggtgtgtga

SEQ ID NO: 317260 - DNA, 532 bp, Homo sapiens
ccagtacttactgatcattgctgatcaataccagaccacttaccaggcactttgcctctagtgagtatacattgctccagctcctcaaagccttaaaataccgttcgaagtcaagaagctaagttacacagcaatagggttagaatgttttttttcctaagggaaatgaatatatttcacaggaatcagacaaggcttctctagctggtgttgataactcacatattttctttccactgccctttattacaggtgtatactttcaacaaaaattgttgctaagccctgcgctaggtgctggagatgtaaagattaataaaagacagttccaaacctgaaggaacctcacagactattgagaaggagagaagcaaacataactgagtatagttgtgaactgctataactgtacaaattgctgtgggaccacttaaaatatataaatacataccctttacattctgcttggagggtaggagtgtgcttataacatggcgcttttaacattctttgctaaataaaatgtaaagat

SEQ ID NO: 317261 - DNA, 216 bp, Homo sapiens
cagtggctgatcaatttaggaccagtcattatgctactcctgaggacacagaaatgaattatttatgttactagtcttcacgcaacctgaaatacatagaaaataaataagaccaaagtttgaaaaagtgaagacattaagttcattaaggtgctgaaaagtagatctctatctgagacaccctgagggctaaaaagaagaaaaagtgcattctac

SEQ ID NO: 317262 - DNA, 2189 bp, Homo sapiens
  misc_feature (90)..(90): n is a, c, g, or t
  misc_feature (189)..(189): n is a, c, g, or t
gtccctgaggtgaagaaagaggagactttgctggatctggactttgatcctttcaagcccgaggtgacacctgcaggttctgctggagtnacccactcacccatgtctcagacattgccctgggacctatggacgacaagcactgatttggtacagccggcttctggtggttcatttaatggattcacncagccccaggatacttcattattcacaatgcagacagaccagagtatgatctgcaacttggctgaatctgaacaggctccacccacagagccaaaagcagaggagcctctggctgctgtcacacctgccgttggtctggaccttggaatggacactcgggctgaggagccagtggaggaggcagtgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattgccaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccctaattccttttga

SEQ ID NO: 317263 - DNA, 1909 bp, Homo sapiens
ctcacccttcaagactctgtctcccatcccctatccctcctcccaattcccaccgaaacctcatgcttaccaaactgcctggctattcaaggatccagaaattaattccactaagggtttaggcctcaggaggaacagaaggaggctgtgtggcacagcggaaggcccagacctgagtctggctagtggggaagtatggaagtggcagccccagctttgggctgggggctaaggcaggttgtgcaggacaaggaggttctgttttccaggccctgccggcatcgccacggtttttcttcccccaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattgccaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccctaattccttttga

SEQ ID NO: 317264 - DNA, 2008 bp, Homo sapiens
  misc_feature (90)..(90): n is a, c, g, or t
  misc_feature (189)..(189): n is a, c, g, or t
gtccctgaggtgaagaaagaggagactttgctggatctggactttgatcctttcaagcccgaggtgacacctgcaggttctgctggagtnacccactcacccatgtctcagacattgccctgggacctatggacgacaagcactgatttggtacagccggcttctggtggttcatttaatggattcacncagccccaggatacttcattattcacaatgcagacagaccagagtatgatctgcaacttggctgaatctgaacaggctccacccacagagccaaaagcagaggagcctctggctgctgtcacacctgccgttggtctggaccttggaatggacactcgggctgaggagccagtggaggaggcagtgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattgccaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccctaattccttttga

SEQ ID NO: 317265 - DNA, 425 bp, Homo sapiens
atccttttctcctctttaagaactcatattataatccagttaatatcaattaactatgctttgtacagtcacaatgtacaaagcattagctatactttatacagtcaataagtcattgcaaatgtttattccttctttttctttttctttttttttttaactaacaacttatttgggataggccttcccattgatcacggcacagcactttacctgtaatgtgacatcctggttcagaaccacaacactaatgtaacacattattaattaattgtggcagtgtggattttccagtagtttgctggaccctgaaagttctgtcattgtttttcaggatgcaggctggctggtgggagtgaaggaatcagactggcttcagtacagagaccttgccacctacaaaggcctctttccagagaacttca

SEQ ID NO: 317266 - DNA, 640 bp, Homo sapiens
gtatttttagtagagacggggtttcgccatattggccaggctggtctcgaactcctgacctcaggtgatccgtctgccttggcctcccaaagtgctggaaatacaggcatgagccactacgcccagcctatactttaaacattgttattcaaaccgtgggccagatacattcatgggtcatgaaatgaacggaatggatcataagcagcactgttttaatggaacagaatgtaacaaactagaaccaaatagaatggactaccatatatctgcagtaacatatagtgaaatttgtatttgcatagttgtgtatatacatgtttactgatcaccaagtaacatacacttcttactgggaagccgggtcaacaaagtttggtatccactgatctaggacagtagtgtctggttgtgttttttcccccttctcaccacttgtgaggaagaaagccccctattagcaacagtgggggacttacacgtggctctggggcagtgcctaaagaacggggataaggaggcaggccccatgtcaaagtggagcaggcaccacctctgcccaggcctgttctgccctggccagggagggatagcctgtaacaatttcagtttgtgcagaacattcaggtatgaaaagaaa

SEQ ID NO: 317267 - DNA, 466 bp, Homo sapiens
agtgtgtcaggcgggagtactgctgtgtggagactgagtgtggcttaaggggatatgcgtggatgccaagtgccaaggaagggcctgcaatggttcactgtatgtgtccacgcggctgggccatggtgcccagacggctggtcaaatgttatcctggatgtttccatgagggtgagtatggatgagataaacatttaaatcagctgactttgggggaagcagactgcccaccacaatgcaggtgggcctcacccaagcagaaaaaggcctccacagagcaaaggctgagctccctaagcagcagtgctgcggctgtggctcctcctaggtctccagcctgctgggccccctgtagattttgggcttcataagtctctatgaacaagccagttccttacaatagatctttctatacgcacaccctattggtttggtctctctggaaaaccctggcacagggtctccg

SEQ ID NO: 317268 - DNA, 4066 bp, Homo sapiens
ccacgcgtccgacgccccccacccgggaggggggagagaggcaaaaagtaagagaggaaaaaaaatagcaggaagatggcgcccaccaagcccagctttcagcaggatccttccaggcgagaacgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactgaggcgccgcccgtcctgggcccggccaggccccgcttggaggaggcatcgtcggcattttcgtttagacctttaattctagcactttgaattcgagcaggtcagcgtcttctctcgccacgacggtccccattccaccccctctttctttcacctgacttattctttcgtgtaaagatatgtttattttttgccttcagagggtcagacgaccagttgcctgccgttttgtcttcttctaaggtgtgtgttgggttgttttgctttcctttgcatctttattaagatgtctttcatgtgtatatgcctctgccatagaatactcagtcttgtggtcaagagagttctcaagtgacaaccattggggtttcttcataaagatcttgatatgatcaagatggaaagagacaagcataaacaatgtgccctgtttgactaagtcaaatgaaatagggtggtttttgtttctgttcctaattcctttaaaaaatagggggaatagtattttagaattttatgcagaatttaattctctttttacggttaagattttaagattttcttacttgcacataaaaataatttgggttcttaaacttaatttctggcctgtgactagaatgtttaaaaaaaaaaaaagtcggactaaatgttaattactgaaacattaacttaatttctaaaaccatggtgctatcatttattaatctgtaatgtcttcatacaaaatgcagctcctgggctgggttttgggggaaaaaaaaaaaatgtgttctgtcctggtctggagtccgttgctgcagtctccttggttagttaagacaaagccctcattaacgtttgctgcaggacttaaaattttttacctcccaactaacaaacatagcctcacattaaatttaatgggtcagtaaagccccttttaaaggggctgctggaaaactcaatcaaactgatttgaggagcagtttaggtacatactgccttttgtttagctttttgttttccttactcagtctaactgaggctaattttgcaacttcaataacacttcggagtaaaagaaggaaaatatttaacatgtttttggtttttttcattccttgcttaaaacaaaaaggaaggttgtatttggggggactggtttgatttgatggaatttctttccctttggttcttatttctgggttgaaaccaataagttttaaaactaaagaatgggttaataagcttcagacagataactgcaactgaaaactgcacattaagtaaaaaaaaaaa

SEQ ID NO: 317269 - DNA, 842 bp, Homo sapiens
cagtgaataaaagatggatagcttctaactctagaatgaagagttcaggcttaagagtgagagctatcactggaaaatgtccttctcaattcagaactacagcacaattcatgttgcagaccaatgtagtgggacccagtttccacctatgttcacgagtgagatgtatgcaagaaacgttttacatggaaaaagcatgcatgtctcctaacgttcagttcataactgctgcattgtgccatcttcatacactggactctttccttcctacatcgttaatgtgtttgagcacagacactgtgttcacctctccagtcacatcgacgtccaagcagatgttctgtggcaaagttacaaagcatttatgtcactttttaaaattaatcaaattctcccttggaaggagtttagttcctctggctttaaaagatattattgctgaaaaataaactctgtatacttgcttttaaaaatctttgtatgccttttgtaggttcagagtgaggggtgctggaggacttttaaagtgtggtattttaaagatgttcttaattgtaaagagcaaactttacatttgtgaaaaagcatctcaaagttagaacatatatctcctaagactagctgacctccctcccgtaaactggtgatttggagacttcaaaattctgtttatcccatagaaacatgtgtatcctaggatgggaaatctgaggcttctttctctcataatttttaataaagtggaatcactagagaaagtaccggggtttcttaactttttaaattgtttttcgttttcactttaattgcataaaaggggtagaaaaattccatcaaccaaa

SEQ ID NO: 317270 - DNA, 624 bp, Homo sapiens
  misc_feature (37)..(37): n is a, c, g, or t
tagccccacaccaattggggaatagtttttgtttttntttcccccgacgaggctttcagagtcgacgagtgcacagacactgtgttcacctctccagtcacatcgacgtccaagcagatgttctgtggcaaagttacaaagcatttatgtcactttttaaaattaatcaaattctcccttggaaggagtttagttcctctggctttaaaagatattattgctgaaaaataaactctgtatacttgcttttaaaaatctttgtatgccttttgtaggttcagagtgaggggtgctggaggacttttaaagtgtggtattttaaagatgttcttaattgtaaagagcaaactttacatttgtgaaaaagcatctcaaagttagaacatatatctcctaagactagctgacctccctcccgtaaactggtgatttggagacttcaaaattctgtttatcccatagaaacatgtgtatcctaggatgggaaatctgaggcttctttctctcataatttttaataaagtggaatcactagagaaagtaccggggtttcttaactttttaaattgtttttcgttttcactttaattgcataaaaggggtagaaaaattccatcaaccaaa

SEQ ID NO: 317271 - DNA, 4132 bp, Homo sapiens
gcggccgcgggggtgccggccggcgcgggcatggggagggccggcgccgcggccaacggcaccccgcagaacgtccagggcatcacctcctaccagcagcgaataactgcccagcatcctctgcccaaccaatcagaatgtaggaaaatctacagatatgacggaatctactgtgaatctacctaccagaatttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactgaggcgccgcccgtcctgggcccggccaggccccgcttggaggaggcatcgtcggcattttcgtttagacctttaattctagcactttgaattcgagcaggtcagcgtcttctctcgccacgacggtccccattccaccccctctttctttcacctgacttattctttcgtgtaaagatatgtttattttttgccttcagagggtcagacgaccagttgcctgccgttttgtcttcttctaaggtgtgtgttgggttgttttgctttcctttgcatctttattaagatgtctttcatgtgtatatgcctctgccatagaatactcagtcttgtggtcaagagagttctcaagtgacaaccattggggtttcttcataaagatcttgatatgatcaagatggaaagagacaagcataaacaatgtgccctgtttgactaagtcaaatgaaatagggtggtttttgtttctgttcctaattcctttaaaaaatagggggaatagtattttagaattttatgcagaatttaattctctttttacggttaagattttaagattttcttacttgcacataaaaataatttgggttcttaaacttaatttctggcctgtgactagaatgtttaaaaaaaaaaaaagtcggactaaatgttaattactgaaacattaacttaatttctaaaaccatggtgctatcatttattaatctgtaatgtcttcatacaaaatgcagctcctgggctgggttttgggggaaaaaaaaaaaatgtgttctgtcctggtctggagtccgttgctgcagtctccttggttagttaagacaaagccctcattaacgtttgctgcaggacttaaaattttttacctcccaactaacaaacatagcctcacattaaatttaatgggtcagtaaagccccttttaaaggggctgctggaaaactcaatcaaactgatttgaggagcagtttaggtacatactgccttttgtttagctttttgttttccttactcagtctaactgaggctaattttgcaacttcaataacacttcggagtaaaagaaggaaaatatttaacatgtttttggtttttttcattccttgcttaaaacaaaaaggaaggttgtatttggggggactggtttgatttgatggaatttctttccctttggttcttatttctgggttgaaaccaataagttttaaaactaaagaatgggttaataagcttcagacagataactgcaactgaaaactgcacattaagtaaaaaaaaaaa

SEQ ID NO: 317272 - DNA, 4042 bp, Homo sapiens
gcggccgcgggggtgccggccggcgcgggcatggggagggccggcgccgcggccaacggcaccccgcagaacgtccagggcatcacctcctaccagcagcgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactgaggcgccgcccgtcctgggcccggccaggccccgcttggaggaggcatcgtcggcattttcgtttagacctttaattctagcactttgaattcgagcaggtcagcgtcttctctcgccacgacggtccccattccaccccctctttctttcacctgacttattctttcgtgtaaagatatgtttattttttgccttcagagggtcagacgaccagttgcctgccgttttgtcttcttctaaggtgtgtgttgggttgttttgctttcctttgcatctttattaagatgtctttcatgtgtatatgcctctgccatagaatactcagtcttgtggtcaagagagttctcaagtgacaaccattggggtttcttcataaagatcttgatatgatcaagatggaaagagacaagcataaacaatgtgccctgtttgactaagtcaaatgaaatagggtggtttttgtttctgttcctaattcctttaaaaaatagggggaatagtattttagaattttatgcagaatttaattctctttttacggttaagattttaagattttcttacttgcacataaaaataatttgggttcttaaacttaatttctggcctgtgactagaatgtttaaaaaaaaaaaaagtcggactaaatgttaattactgaaacattaacttaatttctaaaaccatggtgctatcatttattaatctgtaatgtcttcatacaaaatgcagctcctgggctgggttttgggggaaaaaaaaaaaatgtgttctgtcctggtctggagtccgttgctgcagtctccttggttagttaagacaaagccctcattaacgtttgctgcaggacttaaaattttttacctcccaactaacaaacatagcctcacattaaatttaatgggtcagtaaagccccttttaaaggggctgctggaaaactcaatcaaactgatttgaggagcagtttaggtacatactgccttttgtttagctttttgttttccttactcagtctaactgaggctaattttgcaacttcaataacacttcggagtaaaagaaggaaaatatttaacatgtttttggtttttttcattccttgcttaaaacaaaaaggaaggttgtatttggggggactggtttgatttgatggaatttctttccctttggttcttatttctgggttgaaaccaataagttttaaaactaaagaatgggttaataagcttcagacagataactgcaactgaaaactgcacattaagtaaaaaaaaaaa

SEQ ID NO: 317273 - DNA, 3535 bp, Homo sapiens
acattaatttttcttttttattttccgcaaagtaaacattttctaaatgaggtaaattgattactactgctcttagcacccatcagtcatttatttttagtgaactcaaggattgcacctgagctgtagctgtgaggggctgtgtcaagatctaaatcgtgtgtgtctgtatttttgtattcctcagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactgaggcgccgcccgtcctgggcccggccaggccccgcttggaggaggcatcgtcggcattttcgtttagacctttaattctagcactttgaattcgagcaggtcagcgtcttctctcgccacgacggtccccattccaccccctctttctttcacctgacttattctttcgtgtaaagatatgtttattttttgccttcagagggtcagacgaccagttgcctgccgttttgtcttcttctaaggtgtgtgttgggttgttttgctttcctttgcatctttattaagatgtctttcatgtgtatatgcctctgccatagaatactcagtcttgtggtcaagagagttctcaagtgacaaccattggggtttcttcataaagatcttgatatgatcaagatggaaagagacaagcataaacaatgtgccctgtttgactaagtcaaatgaaatagggtggtttttgtttctgttcctaattcctttaaaaaatagggggaatagtattttagaattttatgcagaatttaattctctttttacggttaagattttaagattttcttacttgcacataaaaataatttgggttcttaaacttaatttctggcctgtgactagaatgtttaaaaaaaaaaaaagtcggactaaatgttaattactgaaacattaacttaatttctaaaaccatggtgctatcatttattaatctgtaatgtcttcatacaaaatgcagctcctgggctgggttttgggggaaaaaaaaaaaatgtgttctgtcctggtctggagtccgttgctgcagtctccttggttagttaagacaaagccctcattaacgtttgctgcaggacttaaaattttttacctcccaactaacaaacatagcctcacattaaatttaatgggtcagtaaagccccttttaaaggggctgctggaaaactcaatcaaactgatttgaggagcagtttaggtacatactgccttttgtttagctttttgttttccttactcagtctaactgaggctaattttgcaacttcaataacacttcggagtaaaagaaggaaaatatttaacatgtttttggtttttttcattccttgcttaaaacaaaaaggaaggttgtatttggggggactggtttgatttgatggaatttctttccctttggttcttatttctgggttgaaaccaataagttttaaaactaaagaatgggttaataagcttcagacagataactgcaactgaaaactgcacattaagtaaaaaaaaaaa

SEQ ID NO: 317274 - DNA, 1224 bp, Homo sapiens
gcggccgcgggggtgccggccggcgcgggcatggggagggccggcgccgcggccaacggcaccccgcagaacgtccagggcatcacctcctaccagcagcgaataactgcccagcatcctctgcccaaccaatcagaatgtaggaaaatctacagatatgacggaatctactgtgaatctacctaccagaatttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggtttgcttcccaccagcgagtgatcagtttcttctgtaggacccctgtcaggaagaacatgcctggatcctacttcagagagaactcagccagggcaaggggctcctgtggctttttgggtgggtgtgagttcatagaggggaaaatcaatactgtaccaggatttagacaatttagcaaaatgcacgaggcagtactttggatgatgaataactacagctgcatggctaacccattggttgtgtaaagtatgggttatcatgttttgtctaaattttcaggcaaaatctagcctgttttgtggcattaggatcatcattatagtagtatgatttttatgctattatacttacgctatgtcccgaatgtttttaaggccagcaaaatggaaacagtagagtacttgcctgaatgcaaataaacttcagtttcaactta

SEQ ID NO: 317275 - DNA, 1163 bp, Homo sapiens
gcggccgcgggggtgccggccggcgcgggcatggggagggccggcgccgcggccaacggcaccccgcagaacgtccagggcatcacctcctaccagcagcgaataactgcccagcatcctctgcccaaccaatcagaatgtaggaaaatctacagatatgacggaatctactgtgaatctacctaccagaatttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagcacagacactgtgttcacctctccagtcacatcgacgtccaagcagatgttctgtggcaaagttacaaagcatttatgtcactttttaaaattaatcaaattctcccttggaaggagtttagttcctctggctttaaaagatattattgctgaaaaataaactctgtatacttgcttttaaaaatctttgtatgccttttgtaggttcagagtgaggggtgctggaggacttttaaagtgtggtattttaaagatgttcttaattgtaaagagcaaactttacatttgtgaaaaagcatctcaaagttagaacatatatctcctaagactagctgacctccctcccgtaaactggtgatttggagacttcaaaattctgtttatcccatagaaacatgtgtatcctaggatgggaaatctgaggcttctttctctcataatttttaataaagtggaatcactagagaaagtaccggggtttcttaactttttaaattgtttttcgttttcactttaattgcataaaaggggtagaaaaattccatcaaccaaa

SEQ ID NO: 317276 - DNA, 1451 bp, Homo sapiens
gcggccgcgggggtgccggccggcgcgggcatggggagggccggcgccgcggccaacggcaccccgcagaacgtccagggcatcacctcctaccagcagcgaataactgcccagcatcctctgcccaaccaatcagaatgtaggaaaatctacagatatgacggaatctactgtgaatctacctaccagaatttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggactcttgaagaaacacaattcctcaggaacagtgagcgagggcagttcatttctccccattaagcaaaggtctccaacaaatatgtttgatgcctttctttccgatttacttttatctcattttccgtacccagaataatttgagagtgctgaaaataaaccactccaccattcactattgtgctattctcctaatttttctggtatcttgccaactaataaacagagaaggtatgctttcaaattctga

SEQ ID NO: 317277 - DNA, 815 bp, Homo sapiens
gcggccgcgggggtgccggccggcgcgggcatggggagggccggcgccgcggccaacggcaccccgcagaacgtccagggcatcacctcctaccagcagcgaataactgcccagcatcctctgcccaaccaatcagaatgtaggaaaatctacagatatgacggaatctactgtgaatctacctaccagaatttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtaagtaaaacaattttagattcttggcagcgattatgaagccttcttcagcctcatgtttttccttcttcaaggaatattctgtttagcatgaattatcaaatgtattatttaatggctttacctgactgttctctcaaagtcagtgagaaacctgtgtgtcagtgttgaacattcagaataaacttgtgctcaaaaactttagt

SEQ ID NO: 317278 - DNA, 269 bp, Homo sapiens
tgcattccagttgactgtagagaatctctagtcatgtctatctgtttttgatgcctctacagaataactgcccagcatcctctgcccaaccaatcagaatgtaggaaaatctacagatatgacggaatctactgtgaatctacctaccagaagtatgttgaaatctttgtgagtcttccttctggctcgtacatcagtgcttgtggttgccagctattcaaaaatatccttgtattgaaaccttctttttatctaatttagtgggggag

SEQ ID NO: 317279 - DNA, 421 bp, Homo sapiens
tggaagaagccatggatatatttttggaataatacaggctagagatccagacttcacaaatgaatatattgttttgaggacactgtcatagaccatgtgtgcagagggagatgccttctcattttggaatcttaattaaggtctaaattcagaaacctgaggctgacaaaaaaaaaagaactttgtcttcctcagttattatttggaaaacatcatgcatcatgctatctctctgggatttgatttacagcttgaagaaacacaattcctcaggaacagtgagcgagggcagttcatttctccccattaagcaaaggtctccaacaaatatgtttgatgcctttctttccgatttacttttatctcattttccgtacccagaataatttgagagtgctgaaaataaaccactccaccattc

SEQ ID NO: 317280 - DNA, 516 bp, Homo sapiens
tgattactactgctcttagcacccatcagtcatttatttttagtgaactcaaggattgcacctgagctgtagctgtgaggggctgtgtcaagatctaaatcgtgtgtgtctgtatttttgtattcctcagtggagtcaaccagccccagtctgctaaccactgacaacactcttgagcgttcctttttcatccgaatgaaatctactctgaccaaacgcggtgtgcacatcaaatcatcaggatataaggtaagccggttccgggaggggagacattgctgtctcaggccagtcctaggtaatttgcattgaattttccagctgctttaggtccatataatgaatacatgtgatcttgaggagcccataggattcccagtcatcttcctgtctcaaggcaggagcttctttacacctctccttctcacttcagacattgctggtgcactaaaaaccccaatatagtgtcttttcttaacacattgattaaaaatatgccaagtgcttcagcacctg

SEQ ID NO: 317281 - DNA, 770 bp, Homo sapiens
cgcggccgcagctccccggcggaggcaagaggtggttggggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaagttgccgagcaaacagtggcagcttgcctctgaaggccaccaaaaaggaccaaaatgtttgcatggaaatggcaaccaagaaacccctaatattaagaacctaccttgaaatctgccaattaatgaatggaagcttcatcagattttcaaatggcttttataaaattatataatggaggtgaaagtgaaaggtctacactataactcctattacatgagctaaatgtgtaagccttaccatttgatgtgctcttctaggcttaacagtaaggaccattttggagttaaaattgtgtggattagttctgtgttaaacatgtcttcatctcatttatgtattgtattaaactctttggggaaacagataaaaaggacattttaggctttacaaacacgctacacaccataaaatgtttgtttcagcccattgcttactccaaagcaatggccttttgcttgaagataatctcaataatagaaaacagttaccaaaggaactaggttttgggtggacgact

SEQ ID NO: 317282 - DNA, 454 bp, Homo sapiens
cgcggccgcagctccccggcggaggcaagaggtggttggggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaaggtaagctaccacttttggttttattttcaagcacaacatgaaataagcattccaaacaagaacattatttccagtcatattttctttccaataaaaaaatgttatttagataattttgaaatatgagggctgtaaatttgggccttaaaaaataattggggcctactaatctgcatatagagctgcctttttctcattgga

SEQ ID NO: 317283 - DNA, 3942 bp, Homo sapiens
  misc_feature (3942)..(3942): n is a, c, g, or t
cgcggccgcagctccccggcggaggcaagaggtggttggggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaagtttgctgttttgtggtccacaagaggtgccatgaatttgttactttttcttgtccgggtgcggataagggacccgacactgatgaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtacaagttgcttaaccaagaagaaggtgagtactacaacgtacccattccggaaggggacgaggaaggaaacatggaactcaggcagaaattcgagaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggatcggctgtacttcgtcatggaatatgtcaacggtggggacctcatgtaccacattcagcaagtaggaaaatttaaggaaccacaagcagtattctatgcggcagagatttccatcggattgttctttcttcataaaagaggaatcatttatagggatctgaagttagataacgtcatgttggattcagaaggacatatcaaaattgctgactttgggatgtgcaaggaacacatgatggatggagtcacgaccaggaccttctgtgggactccagattatatcgccccagagataatcgcttatcagccgtatggaaaatctgtggactggtgggcctatggcgtcctgttgtatgaaatgcttgccgggcagcctccatttgatggtgaagatgaagacgagctatttcagtctatcatggagcacaacgtttcctatccaaaatccttgtccaaggaggctgtttctatctgcaaaggactgatgaccaaacacccagccaagcggctgggctgtgggcctgagggggagagggacgtgagagagcatgccttcttccggaggatcgactgggaaaaactggagaacagggagatccagccaccattcaagcccaaagtgtgtggcaaaggagcagagaactttgacaagttcttcacacgaggacagcccgtcttaacaccacctgatcagctggttattgctaacatagaccagtctgattttgaagggttctcgtatgtcaacccccagtttgtgcaccccatcttacagagtgcagtatgaaactcaccagcgagaacaaacacctccccagcccccagccctccccgcagtgggaagtgaatccttaaccctaaaattttaaggccacggccttgtgtctgattccatatggaggcctgaaaattgtagggttattagtccaaatgtgatcaactgttcagggtctctctcttacaaccaagaacattatcttagtggaagatggtacgtcatgctcagtgtccagtttaattctgtagaagttacgtctggctctaggttaacccttcctagaaagcaagcagactgttgccccattttgggtacaatttgatatactttccataccctccatctgtggatttttcagcattggaatcccccaaccagagatgttaaagtgagcctgtcccaggaaacatctccacccaagacgtctttggaatccaagaacaggaagccaagagagtgagcagggagggattgggggtgggggaggcctcaaaataccgactgcgtccattctctgcctccatggaaacagcccctagaatctgaaaggccgggataaacctaatcactgttcccaaacattgacaaatcctaacccaaccatggtccagcagttaccagtttaaacaaaaaaacctcagatgagtgttgggtgaatctgtcatctggtaccctccttggttgataactgtcttgatacttttcattctttgtaagaggccaaatcgtctaaggacgttgctgaacaagcgtgtgaaatcatttcagatcaaggataagccagtgtgtacatatgttcattttaatctctgggagattatttttccatccagggtgccatcagtaatcatgccactactcaccagtgttgttcgccaacacccacccccacacacaccaacattttgctgcctaccttgttatccttctcaagaagctgaagtgtacgccctctccccttttgtgcttatttatttaataggctgcagtgtcgcttatgaaagtacgatgtacagtaacttaatggaagtgctgactctagcatcagcctctaccgattgattttcctcccttctctagccctggatgtccacttagggataaaaagaatatggttttggttcccatttctagttcacgttgaatgacaggcctggagctgtagaatcaggaaacccggatgcctaacagctcaaagatgttttgttaatagaaggattttaatacgttttgcaaatgcatcatgcaatgaattttgcatgtttataataaaccttaataacaagtgaatctatattattgatataatcgtatcaagtataaagagagtattataataattttataagacacaattgtgctctatttgtgcaggttcttgtttctaatcctcttttctaattaagttttagctgaatcccttgcttctgtgctttccctccctgcacatgggcactgtatcagatagattactttttaaatgtagataaaatttcaaaaatgaatggctagtttacgtgatagattaggctcttactacatatgtgtgtgtatatatatgtatttgattctacctgcaaacaaatttttattggtgaggactatttttgagctgacactccctcttagtttcttcatgtcacctttcgtcctggttcctccgccactcttcctcttggggacaacaggaagtgtctgattccagtctgcctagtacgttggtacacacgtggcattgcgcagcacctgggctgacctttgtgtgtgcgtgtgtgtgtgtttccttcttcccttcagcctgtgactgttgctgactccaggggtgggagggatggggagactcccctcttgctgtgtgtactggacacgcaggaagcatgctgn

SEQ ID NO: 317284 - DNA, 2529 bp, Homo sapiens
cgcggccgcagctccccggcggaggcaagaggtggttggggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaagtttgctgttttgtggtccacaagaggtgccatgaatttgttactttttcttgtccgggtgcggataagggacccgacactgatgaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtacaagttgcttaaccaagaagaaggtgagtactacaacgtacccattccggaaggggacgaggaaggaaacatggaactcaggcagaaattcgagaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggatcggctgtacttcgtcatggaatatgtcaacggtggggacctcatgtaccacattcagcaagtaggaaaatttaaggaaccacaagcagtattctatgcggcagagatttccatcggattgttctttcttcataaaagaggaatcatttatagggatctgaagttagataacgtcatgttggattcagaaggacatatcaaaattgctgactttgggatgtgcaaggaacacatgatggatggagtcacgaccaggaccttctgtgggactccagattatatcgccccagagataatcgcttatcagccgtatggaaaatctgtggactggtgggcctatggcgtcctgttgtatgaaatgcttgccgggcagcctccatttgatggtgaagatgaagacgagctatttcagtctatcatggagcacaacgtttcctatccaaaatccttgtccaaggaggctgtttctatctgcaaaggactgatgaccaaacacccagccaagcggctgggctgtgggcctgagggggagagggacgtgagagagcatgccttcttccggaggatcgactgggaaaaactggagaacagggagatccagccaccattcaagcccaaagtgccctgtgagatgggtactatggtccccagtttgcagtggaggaaacagtcacagagaggctgagtaacttgccagaagacacacagctgatagatggtgaaaccaggacgagtctttgtcctcacctactgcaccatcgctccatctcagcaactgccctgacgctgatgctgtgggccctaattgttgattgcggccagcaagtgcctttcatgtttatatctctagaggtaaactgagagcctttaagaagtcagcctgctcactcaccacctgccactttgcagagcctccaagggcgtcctgtttctaagggccgggcggactgtgccttccagctctgccaccatcttggccagcatcaggcagctccccattgtgcctctgcccggggactgcagagagctgctttatgccacagtcagtttcagaagcatcgccctgttggtttcgctcaaatgtgtctcctctgacaggtgccccatgagcaggccaggggacccacctggggtggcacagttgccaactgggtggcacacagccttattcttagagcagcaacttcctcaccatgtgtgcctctgtgtcctctaccccaagaataaaactgctgttggtgagcccact

SEQ ID NO: 317285 - DNA, 3754 bp, Homo sapiens
  misc_feature (3754)..(3754): n is a, c, g, or t
aattatgccacccacagcaccgacctcatctgggggtttggggagacaagggttccagtgccaagtttgctgttttgtggtccacaagaggtgccatgaatttgttactttttcttgtccgggtgcggataagggacccgacactgatgaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtacaagttgcttaaccaagaagaaggtgagtactacaacgtacccattccggaaggggacgaggaaggaaacatggaactcaggcagaaattcgagaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggatcggctgtacttcgtcatggaatatgtcaacggtggggacctcatgtaccacattcagcaagtaggaaaatttaaggaaccacaagcagtattctatgcggcagagatttccatcggattgttctttcttcataaaagaggaatcatttatagggatctgaagttagataacgtcatgttggattcagaaggacatatcaaaattgctgactttgggatgtgcaaggaacacatgatggatggagtcacgaccaggaccttctgtgggactccagattatatcgccccagagataatcgcttatcagccgtatggaaaatctgtggactggtgggcctatggcgtcctgttgtatgaaatgcttgccgggcagcctccatttgatggtgaagatgaagacgagctatttcagtctatcatggagcacaacgtttcctatccaaaatccttgtccaaggaggctgtttctatctgcaaaggactgatgaccaaacacccagccaagcggctgggctgtgggcctgagggggagagggacgtgagagagcatgccttcttccggaggatcgactgggaaaaactggagaacagggagatccagccaccattcaagcccaaagtgtgtggcaaaggagcagagaactttgacaagttcttcacacgaggacagcccgtcttaacaccacctgatcagctggttattgctaacatagaccagtctgattttgaagggttctcgtatgtcaacccccagtttgtgcaccccatcttacagagtgcagtatgaaactcaccagcgagaacaaacacctccccagcccccagccctccccgcagtgggaagtgaatccttaaccctaaaattttaaggccacggccttgtgtctgattccatatggaggcctgaaaattgtagggttattagtccaaatgtgatcaactgttcagggtctctctcttacaaccaagaacattatcttagtggaagatggtacgtcatgctcagtgtccagtttaattctgtagaagttacgtctggctctaggttaacccttcctagaaagcaagcagactgttgccccattttgggtacaatttgatatactttccataccctccatctgtggatttttcagcattggaatcccccaaccagagatgttaaagtgagcctgtcccaggaaacatctccacccaagacgtctttggaatccaagaacaggaagccaagagagtgagcagggagggattgggggtgggggaggcctcaaaataccgactgcgtccattctctgcctccatggaaacagcccctagaatctgaaaggccgggataaacctaatcactgttcccaaacattgacaaatcctaacccaaccatggtccagcagttaccagtttaaacaaaaaaacctcagatgagtgttgggtgaatctgtcatctggtaccctccttggttgataactgtcttgatacttttcattctttgtaagaggccaaatcgtctaaggacgttgctgaacaagcgtgtgaaatcatttcagatcaaggataagccagtgtgtacatatgttcattttaatctctgggagattatttttccatccagggtgccatcagtaatcatgccactactcaccagtgttgttcgccaacacccacccccacacacaccaacattttgctgcctaccttgttatccttctcaagaagctgaagtgtacgccctctccccttttgtgcttatttatttaataggctgcagtgtcgcttatgaaagtacgatgtacagtaacttaatggaagtgctgactctagcatcagcctctaccgattgattttcctcccttctctagccctggatgtccacttagggataaaaagaatatggttttggttcccatttctagttcacgttgaatgacaggcctggagctgtagaatcaggaaacccggatgcctaacagctcaaagatgttttgttaatagaaggattttaatacgttttgcaaatgcatcatgcaatgaattttgcatgtttataataaaccttaataacaagtgaatctatattattgatataatcgtatcaagtataaagagagtattataataattttataagacacaattgtgctctatttgtgcaggttcttgtttctaatcctcttttctaattaagttttagctgaatcccttgcttctgtgctttccctccctgcacatgggcactgtatcagatagattactttttaaatgtagataaaatttcaaaaatgaatggctagtttacgtgatagattaggctcttactacatatgtgtgtgtatatatatgtatttgattctacctgcaaacaaatttttattggtgaggactatttttgagctgacactccctcttagtttcttcatgtcacctttcgtcctggttcctccgccactcttcctcttggggacaacaggaagtgtctgattccagtctgcctagtacgttggtacacacgtggcattgcgcagcacctgggctgacctttgtgtgtgcgtgtgtgtgtgtttccttcttcccttcagcctgtgactgttgctgactccaggggtgggagggatggggagactcccctcttgctgtgtgtactggacacgcaggaagcatgctgn

SEQ ID NO: 317286 - DNA, 3083 bp, Homo sapiens
  misc_feature (3083)..(3083): n is a, c, g, or t
cagcacgggcgttccccacagggttcctcacagtaatgtctgagacttagctttgctgctggagaaatattgacccactctttgtgcttcattgtcgtggcttcctgaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggatcggctgtacttcgtcatggaatatgtcaacggtggggacctcatgtaccacattcagcaagtaggaaaatttaaggaaccacaagcagtattctatgcggcagagatttccatcggattgttctttcttcataaaagaggaatcatttatagggatctgaagttagataacgtcatgttggattcagaaggacatatcaaaattgctgactttgggatgtgcaaggaacacatgatggatggagtcacgaccaggaccttctgtgggactccagattatatcgccccagagataatcgcttatcagccgtatggaaaatctgtggactggtgggcctatggcgtcctgttgtatgaaatgcttgccgggcagcctccatttgatggtgaagatgaagacgagctatttcagtctatcatggagcacaacgtttcctatccaaaatccttgtccaaggaggctgtttctatctgcaaaggactgatgaccaaacacccagccaagcggctgggctgtgggcctgagggggagagggacgtgagagagcatgccttcttccggaggatcgactgggaaaaactggagaacagggagatccagccaccattcaagcccaaagtgtgtggcaaaggagcagagaactttgacaagttcttcacacgaggacagcccgtcttaacaccacctgatcagctggttattgctaacatagaccagtctgattttgaagggttctcgtatgtcaacccccagtttgtgcaccccatcttacagagtgcagtatgaaactcaccagcgagaacaaacacctccccagcccccagccctccccgcagtgggaagtgaatccttaaccctaaaattttaaggccacggccttgtgtctgattccatatggaggcctgaaaattgtagggttattagtccaaatgtgatcaactgttcagggtctctctcttacaaccaagaacattatcttagtggaagatggtacgtcatgctcagtgtccagtttaattctgtagaagttacgtctggctctaggttaacccttcctagaaagcaagcagactgttgccccattttgggtacaatttgatatactttccataccctccatctgtggatttttcagcattggaatcccccaaccagagatgttaaagtgagcctgtcccaggaaacatctccacccaagacgtctttggaatccaagaacaggaagccaagagagtgagcagggagggattgggggtgggggaggcctcaaaataccgactgcgtccattctctgcctccatggaaacagcccctagaatctgaaaggccgggataaacctaatcactgttcccaaacattgacaaatcctaacccaaccatggtccagcagttaccagtttaaacaaaaaaacctcagatgagtgttgggtgaatctgtcatctggtaccctccttggttgataactgtcttgatacttttcattctttgtaagaggccaaatcgtctaaggacgttgctgaacaagcgtgtgaaatcatttcagatcaaggataagccagtgtgtacatatgttcattttaatctctgggagattatttttccatccagggtgccatcagtaatcatgccactactcaccagtgttgttcgccaacacccacccccacacacaccaacattttgctgcctaccttgttatccttctcaagaagctgaagtgtacgccctctccccttttgtgcttatttatttaataggctgcagtgtcgcttatgaaagtacgatgtacagtaacttaatggaagtgctgactctagcatcagcctctaccgattgattttcctcccttctctagccctggatgtccacttagggataaaaagaatatggttttggttcccatttctagttcacgttgaatgacaggcctggagctgtagaatcaggaaacccggatgcctaacagctcaaagatgttttgttaatagaaggattttaatacgttttgcaaatgcatcatgcaatgaattttgcatgtttataataaaccttaataacaagtgaatctatattattgatataatcgtatcaagtataaagagagtattataataattttataagacacaattgtgctctatttgtgcaggttcttgtttctaatcctcttttctaattaagttttagctgaatcccttgcttctgtgctttccctccctgcacatgggcactgtatcagatagattactttttaaatgtagataaaatttcaaaaatgaatggctagtttacgtgatagattaggctcttactacatatgtgtgtgtatatatatgtatttgattctacctgcaaacaaatttttattggtgaggactatttttgagctgacactccctcttagtttcttcatgtcacctttcgtcctggttcctccgccactcttcctcttggggacaacaggaagtgtctgattccagtctgcctagtacgttggtacacacgtggcattgcgcagcacctgggctgacctttgtgtgtgcgtgtgtgtgtgtttccttcttcccttcagcctgtgactgttgctgactccaggggtgggagggatggggagactcccctcttgctgtgtgtactggacacgcaggaagcatgctgn

SEQ ID NO: 317287 - DNA, 1025 bp, Homo sapiens
cgcggccgcagctccccggcggaggcaagaggtggttggggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaagtttgctgttttgtggtccacaagaggtgccatgaatttgttactttttcttgtccgggtgcggataagggacccgacactgatgaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtacaagttgcttaaccaagaagaaggtgagtactacaacgtacccattccggaaggggacgaggaaggaaacattgggaactttcagggcaggaaaatttcggagggtggaggggatttaaccaaaaagtggcccccgggaaaaccaaccctttt

SEQ ID NO: 317288 - DNA, 905 bp, Homo sapiens
cgcggccgcagctccccggcggaggcaagaggtggttggggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaagtttgctgttttgtggtccacaagaggtgccatgaatttgttactttttcttgtccgggtgcggataagggacccgacactgatgaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtatggaagccgcttaggttgagtatgtctcaaagc

SEQ ID NO: 317289 - DNA, 746 bp, Homo sapiens
acaatatgtataaataaaaaggtgcatgtatctgtgtaactactatttgtctatctatcaatagagagaaaagaatgagattcttttcaaagatgctttataatatttagaggaattcaagtacaaagatgaaagtcagggtttggggcaggttcaaatgtctatgccaggcatagctccttttcaatttgtatttcttcccttgcttcattatctgtttccacccctaccctgcagctgaggatgcagacctggggtactggacaggaccaccttcttgagccccatccctgatgtcacaccacctctgtgacggatggatccttctagagagagtttcaggactgagtgccagcattcttcagctgtctcaggcaggggaggaacctgaggagccagaaagaaccttccttaccgaatgttatgccatggtgttgatcacgagcagtcactgggtcaggggctgttgacgcagaaagagtgcattcgagggaggaacagcacgggcgttccccacagggttcctcacagtaatgtctgagacttagctttgctgctggagaaatattgacccactctttgtgcttcattgtcgtggcttcctggtgagtaaacttcctgtttttctgggcaatgagttcagctttttataaaggtcagagttctaaacaaacaaacaaaatacaggccagaggacctgagcaaaacgaagcatttctcttgggaggctggtcagaggccgcagg

SEQ ID NO: 317290 - DNA, 493 bp, Homo sapiens
gttaatttgttccgtgaaggtcagatgaaggttgtggagattttaagaggaatgctcttttctaccataccagcagagtgcacatttttcacttctgttttgctaaaactacccccagccaagcaatccaatggattctgagcatcttctatgtgtagggcgttgcactgtgatatggtttggctctgtgtccccacccaaatcccatcttgaactgtactcccataattcccaagtgttgagggagggacctggtgggagataattgaatcatgggggcggtttcctccatactgttctcatggtattgaataagtttcacgagatctgatggttttatcggggtttttgcttttgtgtctttctcattctctctttgcctgctgccatccatgtaagacgggacttgttcctcctccttgccttcgccatgattgtgaggcttccccagccacgtggaactgtaagtccaattaaacctttcttttgtaaa

SEQ ID NO: 317291 - DNA, 1288 bp, Homo sapiens
gcacgagagcttttctacatgatataagcaggtattgcatattttcatatatctgggggaaaataaaggaagactccaaataaattgtaaaatacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttca

SEQ ID NO: 317292 - DNA, 3198 bp, Homo sapiens
ataaccctgatgttttcttttcctgcagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttca

SEQ ID NO: 317293 - DNA, 4729 bp, Homo sapiens
ggccgcggaggctcgggacccggctggccgcgcggcgccgcagccgccccctcccccacaccccctcccccccgcggcggcggcgcgagcgggcggcggctgtgcggtgcggtgcagagcggaggcggaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttca

SEQ ID NO: 317294 - DNA, 4905 bp, Homo sapiens
ggccgcggaggctcgggacccggctggccgcgcggcgccgcagccgccccctcccccacaccccctcccccccgcggcggcggcgcgagcgggcggcggctgtgcggtgcggtgcagagcggaggcggaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttcatatgtgtctgataagtggttgaatagtcgtttggcgctgttgtatggtgtgattgtcagtgtatggtgtcacttcctatagccagccagcatactttgccttcccctatagcacttagctgggcattactttattatgacatatgtgcactaaaaaatgaaaaaaaggaaaaaaag

SEQ ID NO: 317295 - DNA, 4626 bp, Homo sapiens
ggccgcggaggctcgggacccggctggccgcgcggcgccgcagccgccgaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaaggtgccacatgacaggacgagtattatgggaaacattgatctcactccgatggtgtggacctgagcagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttca

SEQ ID NO: 317296 - DNA, 4789 bp, Homo sapiens
ggccgcggaggctcgggacccggctggccgcgcggcgccgcagccgccgaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcaggtaagtgcgatggtgagaattcctcccactttcttgtgtgtgtttctttcctgatggcctccgcgttatgccggattcttcctgagctccccaagttgcaggccacgtacatgaagccagtgtggtttcaaagattgagagaggtgccaccttcattcaggtgaaaaagcatagctttgagcgaattctcactaagttcagctcttttgattcaagtcaatctgaaagtcccagccagccaagtgacgctgacattaaggaccagccagaaaatgtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaaggtgccacatgacaggacgagtattatgggaaacattgatctcactccgatggtgtggacctgagcagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttca

SEQ ID NO: 317297 - DNA, 4256 bp, Homo sapiens
tgggcatctgatccaggacaactcgcccaggagcccggcgggtttcagctgccaccacgaaagatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaaggtgccacatgacaggacgagtattatgggaaacattgatctcactccgatggtgtggacctgagcagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttca

SEQ ID NO: 317298 - DNA, 4435 bp, Homo sapiens
agttgtggacgatagcagcaatgggaagcagtatttgagaagaaatcagactctcttcttccagtcttttgcaagtaggtgacacaagaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggttgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcaggtaagtgcgatggtgagaattcctcccactttcttgtgtgtgtttctttcctgatggcctccgcgttatgccggattcttcctgagctccccaagttgcaggccacgtacatgaagccagtgtggtttcaaagattgagagaggtgccaccttcattcaggtgaaaaagcatagctttgagcgaattctcactaagttcagctcttttgattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaaggtgccacatgacaggacgagtattatgggaaacattgatctcactccgatggtgtggacctgagcagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttca

SEQ ID NO: 317299 - DNA, 1931 bp, Homo sapiens
acctaaaactgaaaatatgctgtgagaaatagaccacccaaataatatagggggttgtggggtgtggcaccgttaaggcatctaaaccaaaattccacctggctttggcttattaaacacttttacactatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttca

SEQ ID NO: 317300 - DNA, 2784 bp, Homo sapiens
ggccgcggaggctcgggacccggctggccgcgcggcgccgcagccgccgaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaaggtgccacatgacaggacgagtattatgggaaacattgatctcactccgatggtgtggacctgagcagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacccagcacctcccccgcaaaccgattcgtcagtgttggaccacgggatccaagctttgtaaatatccctcaacagacacagtcctggtacctgagataaaagttgca

SEQ ID NO: 317301 - DNA, 1501 bp, Homo sapiens
ggccgcggaggctcgggacccggctggccgcgcggcgccgcagccgccgaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatgatggtaagtttagcttgggactctagctgctgctttcagagtccacagcagccagcaggccgactaagtgtgaggatttgggggcctaccctataagtagcccacagtaggaacaactccaaagactcggaaaaactcaagtagattacttttaatagggcagcttcttgttctcgggatcaccccagcagcctcaggacccccggccctaaacactattagggtgcccatgagaacctgaattcccaagaacgttgattacccaattaaactatgagaagtggggttaatttaccaaatcagatttttttttaatagcattaagtgaggagtcatggctttttcatttcattttagttctttaatgtgcaaatgccccatgatcatcttcactagtgatttaagatcattcattcacaagcagttttaagccttttgggagctcaacactttgccaattcctttaagaaa

SEQ ID NO: 317302 - DNA, 1297 bp, Homo sapiens
ggccgcggaggctcgggacccggctggccgcgcggcgccgcagccgccgaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcaggaggagttggaagatgaggagtaacacaacactttagatatacatgttaaaaacttataacaaatcatagatcatactaaaggattaccgaagtttagaacatggctgagggtatagatgtcagattttcttacacaatagtgggtcttttgtttcagagttcactcttggcaagcaactccctaccactgcgttaatttcctgtcgatctttcattcagcaacagacctagagatggggagcagacactgccccccccacccaggctttttaagactgtgctttgtgtagattaaaaagacgaaggaaaaaagaataaactttttccaaaca

SEQ ID NO: 317303 - DNA, 748 bp, Homo sapiens
agacccaggcccctcccctgagcccctctcccctcaaaccacccctttgctacatgctaccaggtactgaggctgcacctgggactcctcttaagttggtccttgttgggtggtcagggtgaggcacagggggtgggaggcaaacccttccaagattctctggggcagaaagaatcaggtccaaatgccttagcaagacttcacaatctggctctgaagcaccattccgggcccatcactgcctcccttccctttccctcttttcttttacccctctctcgccctctgtccctcctccctccctctctttgccttgtcttccttcgtaaatctaaagcccctccccattcctaggaacatacccaagagaactgaaaacaggtgttcacacaaagcttgcacacaagcgtccactattcataatagtccacaaggggaaaaacccgacagtggatgcactgataaaataccgtatagccatacagtgggatcttagccataaaaaagaatggcggactgatacatgctgctgcagggacaaaccttgaaaacatcatgctaagtgaaacaaacctgacaggccgggtgcagtggcttacgcctgtaatcccaacactctgggaagccgaggtgggcggatcacttgaggtcagtggttcgagaccagcctgggcaacatggtgaaaccctgtctctactaaaaatacaaaaatcagttggcacggtggcgggtgcctgtaatcccagc

SEQ ID NO: 317304 - DNA, 467 bp, Homo sapiens
gtaagtcaccgtgaactattattattttttaatccttgtccatattgaccttgttatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacagaagacacgcatgcc

SEQ ID NO: 317305 - DNA, 482 bp, Homo sapiens
attttaaggtacgttcaccattctgtttctttaatgaaagtgtatacaatccataaaaatcttcatctatagcactaaatctttgggcaccatcatgtagaatatcctacagttgtcactcacagacttgcagccacctgacttcatgccctccgaagtgattcaacagagccacattctccatcagaccttcttcccatgtctccaagtgtgtatgcggtgttgagagaaaacctgagtcccacaacaattgaaactgcagtatgttccctttattttccattgctggtcaaaggtgtttccaacgatgcaaaggtggtgtgtgaatcaaaggggctgaaatactgcctgggtagggagaaaacacatttattggaacaaattcatgagcataacacaaaaggtgtctggatggtcctgcgtgttgctgatattatgcgtattgaaagcagacaccttcagttacttaaactgctttacgt

SEQ ID NO: 317306 - DNA, 3379 bp, Homo sapiens
aaatgaaaagaccactgaagtgggaagggaaacacctgggctattatcgggctccgtggctaacttattgagtcctcttggtcacctcactgggtctcttcagatatgaaagaggatttagcattagatgggaccaagacttcctccaactctgtgattctagaacaggctgatgtcacaaagggagaagaacgcaccgtagcaaccaggggcaaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccaggtaagtaactctgcagaggatctcagattgtctaaggaaaccactgaagaaaatgtatgccccgcccctcccctttttcctggcactgctgagccacctgcagttgcgagagccgctgggagggataagagggaagaggacgcccggtgaaggggctccagcctggcagtttctgcgtgttagcatttctagaatagagtgggtgggaactgacccaagtaaagtcccagagactcgaacactgacgcacaggaaagcctcaagtgggaggagaaatgcaaatcccctactgatgatggcgtcagcggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacagaagacacgcatgcc

SEQ ID NO: 317307 - DNA, 2992 bp, Homo sapiens
aaatgaaaagaccactgaagtgggaagggaaacacctgggctattatcgggctccgtggctaacttattgagtcctcttggtcacctcactgggtctcttcagatatgaaagaggatttagcattagatgggaccaagacttcctccaactctgtgattctagaacaggctgatgtcacaaagggagaagaacgcaccgtagcaaccaggggcaaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacagaagacacgcatgcc

SEQ ID NO: 317308 - DNA, 2630 bp, Homo sapiens
aaatgaaaagaccactgaagtgggaagggaaacacctgggctattatcgggctccgtggctaacttattgagtcctcttggtcacctcactgggtctcttcagatatgaaagaggatttagcattagatgggaccaagacttcctccaactctgtgattctagaacaggctgatgtcacaaagggagaagaacgcaccgtagcaaccaggggcaaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccaggtaagtaactctgcagaggatctcagattgtctaaggaaaccactgaagaaaatgtatgccccgcccctcccctttttcctggcactgctgagccacctgcagttgcgagagccgctgggagggataagagggaagaggacgcccggtgaaggggctccagcctggcagtttctgcgtgttagcatttctagaatagagtgggtgggaactgacccaagtaaagtcccagagactcgaacactgacgcacaggaaagcctcaagtgggaggagaaatgcaaatcccctactgatgatggcgtcagcggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattgtgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacagaagacacgcatgcc

SEQ ID NO: 317309 - DNA, 2940 bp, Homo sapiens
aaatgaaaagaccactgaagtgggaagggaaacacctgggctattatcgggctccgtggctaacttattgagtcctcttggtcacctcactgggtctcttcagatatgaaagaggatttagcattagatgggaccaagacttcctccaactctgtgattctagaacaggctgatgtcacaaagggagaagaacgcaccgtagcaaccaggggcaaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacagaagacacgcatgcc

SEQ ID NO: 317310 - DNA, 1579 bp, Homo sapiens
aattttcaaacattaaaataaggaaaaacttgtctaaatttcaactgaaaaaaaactatgccagaatttttaaagccagaaattatcttgttttgaagacttaaaatcattctgtttggggaaatgaagattttccaaactgtatataacttttaaaacaataagagggaatgttcaataatagagactgtttgggggtatttactttattaatttattaataaatatattaatttatatagaaacaagtcttctattagatagtgagtatgcatttgtgaggtaacaatttatttctctcttccttagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacagaagacacgcatgcc

SEQ ID NO: 317311 - DNA, 3211 bp, Homo sapiens
aaatgaaaagaccactgaagtgggaagggaaacacctgggctattatcgggctccgtggctaacttattgagtcctcttggtcacctcactgggtctcttcagatatgaaagaggatttagcattagatgggaccaagacttcctccaactctgtgattctagaacaggctgatgtcacaaagggagaagaacgcaccgtagcaaccaggggcaaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccaggtaagtaactctgcagaggatctcagattgtctaaggaaaccactgaagaaaatgtatgccccgcccctcccctttttcctggcactgctgagccacctgcagttgcgagagccgctgggagggataagagggaagaggacgcccggtgaaggggctccagcctggcagtttctgcgtgttagcatttctagaatagagtgggtgggaactgacccaagtaaagtcccagagactcgaacactgacgcacaggaaagcctcaagtgggaggagaaatgcaaatcccctactgatgatggcgtcagcggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatgtgagtaatgttagtcacatgtgaaatatttttataaaaagctttcctataggagatttaaaggtagagcagagtacacataactgagaacaaagcattgtaatgtgcaatgtcccatttcctttaatacataaggctagccttcagggcacacttaccacaatctattgtgcctaaaattataaaattccccttttatatgccatatatgccacagtaagttgagtgttctgatatgaaat

SEQ ID NO: 317312 - DNA, 1360 bp, Homo sapiens
aaatgaaaagaccactgaagtgggaagggaaacacctgggctattatcgggctccgtggctaacttattgagtcctcttggtcacctcactgggtctcttcagatatgaaagaggatttagcattagatgggaccaagacttcctccaactctgtgattctagaacaggctgatgtcacaaagggagaagaacgcaccgtagcaaccaggggcaaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccaggtaagtaactctgcagaggatctcagattgtctaaggaaaccactgaagaaaatgtatgccccgcccctcccctttttcctggcactgctgagccacctgcagttgcgagagccgctgggagggataagagggaagaggacgcccggtgaaggggctccagcctggcagtttctgcgtgttagcatttctagaatagagtgggtgggaactgacccaagtaaagtcccagagactcgaacactgacgcacaggaaagcctcaagtgggaggagaaatgcaaatcccctactgatgatggcgtcagcggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggtaatattttctgaccttgtgatcttgttatcaccttgaactcaatttttctgaaacagaaattattatctttggtagggtacagtggctcacacctgtaatcctaacactttgggaggcaaaggtggga

SEQ ID NO: 317313 - DNA, 764 bp, Homo sapiens
ggttttaggaggtatagtaaatgtcaaatacgtttgccttcaagttgctccaagtctaaatgttgaggggacaagagatagggaaagagcttgttgataatagaaattcacatagacagctgtgggcaggatgtggggtgtttggcagagtgggagtgaaaactttttggagcaggtagaacaggagttcattttagagcaaggaaggctgtagtttaggggcacagaaagaaggctgctcccttcattagggttgaattatgaaaaaaaaccttagtgaaatttttgtatccttggatatattggaattcagtcataacattgactaattctaaggaaagaagaaaatatgtactagggctatgaacaatattttaaaactctaattctacaccttcttttatagcatgtctcagtggaatcaagtccaacagttagaaatcaagtttttggagcaggtggatcaattctatgatgacaactttcccatggaaattcggcatctgttggcccaatggattgaaaatcaagactggtaggatcaaacatattttccctagaagttgatgcacaaatgtctgatgctctatccatgtgaatttattttatggtccactttttactcagtagatgcattcttttcaggtaaagaactttctcaaggatttgaaagccttcccaaagaaggggaataattgtcctttctggttccattcattgtaaatgaaaagttaatggttccagtgcttcttttctctgtaaac

SEQ ID NO: 317314 - DNA, 2368 bp, Homo sapiens
atagtgaaaatgttagaggataagattttaaatacttcttgatttaaattaaaatactataagaaatgtatgtatatttggatttgaagattttttttccccagatttataatgaatttggaacttacaagaacaatgaggatgatggtgcaatcagagtcatttagatagatggtgagccttttctgtccatgctatgattaagtcctctgtttaaacccaaatgcaatctgagtgacacatgaataaaattaattagattaattttgaaataagagaatatgcaaaattaaccaaaaaacccccagaaaacactggtcatctccttctctaatgaataaggaaataagatcataaatagtcccatctcaacatgcatatgcaattgaaaaaactgccctcacaggcaatcctggcacaatcctaggctcataaaatttctctatcttttcttgtaaataagtctccagtcatcattctaaatgggaatcatttttaatgaaataattataactgttttctgaaatataatcataatcagtgtttctagttcaaggtacaattgaactaatccataattttacccttttctttttgataagagagtgtttcatgagggtatctttggtagagatcttttctcaagtattttataaaatattcgagtttgatgaagatggtagataaatacaccagctgtcagatgcctataattttcacaaaatgtgaagaattcattgtatcttaggatgaccataaaaaaattcatggtgtggaatctctaagcattaatagagacaacagcgctactgcagtaatacacagctactacaaatcagtggcagagcaagaataagtggtgtatcaggcaatgtgaagtttttgccttttctcctaatgctgtggttgagttttcctggaaatgaaggaaaaaaacatagcaaaagtagggtgtgttaatgaatctgatgagcaacaagtctaaaaatagcaaaagtgcaaaatggaagttaaaaaacgcaactggcacctgaagcatatttccccttctttatctccagtgctatgcctctgctaaaaatatgaatcacaaagcaaaggaaaaagagaaaaaaagtgttgtaatacagtaaaaatcactataataaaagtttataagaattgagttttttggaattgactttggcctagtaaccattagtatttcttaatttttcagcatttattccatactaatgtgataacaactgtgtgtgttacctagagaaaatgctgtagatccacacatttgaacagaaatgtttatcgatgccataacgtgatacatttgctttccggtgttgttttttgtttatattatttagggaaattttaccttaccatcacagattttgttactttaataatgcagaactatatttatttaatctagattttgttttaaaattatcaagtgttagcttttacaaataagaggcttataatgtggccagatattcttagaattcttttaggtctaagtgttttcaaaactttaagaaatacattctatttttgcaccatttaaaattttgtttccttttaagttttattaagtacacgagaagtttattatttttcattgaatccaagtgaatttatggatatgtacttatcttttatatgaatgtaatagcttgctttcagttcctcacaggtcattgaaattatttaaccaatgaaaacattctctgttacttccaaagtcaactatgtttatcaaaatctcactagtgtgagaaaaataacaagtgtaatattaaagcattgtgcaatatcttgagttggaacataatattcagaaaattaaaatcatttaaaatgagtatgcaacctttttatttaaaatcatttgctccaaaatagttttcatctctgcatttcatattttcttaaaaatatggtgtctttcactatggataggcagatgtggtagagcagggctgccaggatgagggatgctcttcctctggattacacaacggtttgattctttagtaagatgaaaactttaagacaccaagaaatggaaactggttaaagggtttccctccctgctttattcccacaaactgcactgtcaatcaacattcagatgttactccacagccgctgctgtcaatctaaaggtagatcactcagtagagcaaaggctcctgaggctttgccagcagtccacagcccagtatctacagaggcatttgggtcatggtttttgcaaagtgggatgtgggtgagagtggggttgtgttctgacttcctttattgctatcagcctgtgccagaaatagggatctatatagctacatccaatcctaacttatctctg

SEQ ID NO: 317315 - DNA, 730 bp, Homo sapiens
agcgggggctttctcaccgtgcgacgccccaacccgccgctccgccgcggtggtacgctccaggccgcgaggcacaccgagcggacgccagtggatgaccagcggcgggggaggaggagtctggaaggcaaggtcaaggagacagtgcacaatgcctttggggaccatcttaaagagcaactatcagcaactccccctgacttcagctgtgctcttgaacttctgaaagaaattaaagagatcttgctatcactgctattaccacgccagaaccgcctgagaattgagatggaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggatactgagaatgaccatagtgaaggagatctagactgaaggcttcaaggtccagagacttagctgttcccaattctgccactgactcaccctgggtattgggttctgggccacatgtcatcttctgaaaatgtaggagagggatcttccaggttctgggccggatgaaaatggacatggtgaactacactatccagagccttcaaccccacctgcaggaacattccattcagtatgaacgggctaaattccaggaactcctcaataagcagcctagt

SEQ ID NO: 317316 - DNA, 1402 bp, Homo sapiens
agttcccttgcactcccctctgcctttgcaactgatcatcctccctttctccttggcttgaagcatctatgtccagtatctgtgaaatgatgttttatctgtgtgtcaggatgagaaacggcagtcattccaccaagtgttggaaactggttagcctggagacaagggtttctggggccacagctcagggatgtgtatttaattacaggatccccagaaactcctctctaggctgccacagcaacattttttctgggcttgggagccatacctgaactgtttcctccaaggcgggaactccagagagcctgccaagtctggagcaagctggggcttctgctttggccagacctgggccaccatgagacttgaaggcttctagctgtcctacgacacgagccacggtggccctgcctctccccgctcatagaagcctggtccctctgtctagcccagttcccatctagcatccgtcttctgggcctgaagccctaaatggaccacagcctgcacaggaatcaactgtaggctcaaagggaggcggtgagtaaggtcagagcctgctccaagcccaagaacaaaagttgtgttatgggtggaggctagtcccccagatctagccctgccgtctttgccctttaatgaccattgttttctttctctaaaatgtcttgtaataggtgataatgttgttgattcaaatttccatgaaaaagaaaaaaaaaactacctcttaagcgacatcctggtcgattcctctctgaggaatcctgtgggaaaagaatactgtagctcctgctctgtttacatgtttctgtcgggaaagaagccccgcctgccctggggtgttggtgtttttgtctgtgttgccatcccaggtctgccataggggctggtggctgcattgtgatgtctgggctgtgtctggggattccttcccacctacccagccagggactagtcacccccctgaagaggcctccatttccttcctgtgctccagggcatagggagcaccactcccacagacaccacctttaagggctctagtggcacacacatccacgagcctacccccaggttacctgccctaggtccacctccacccacagtcctgtgtgtaggaatcgaggaaacgggatgtccctgagcccttgtctccaaagggccggccaagggctgcccgccagcctgactccatcaaccctccatgaccaaatgatagctggcgggctctgcaggctacccaggccctctgctacctcccaccctgccagctggcaagggatgggccctgttctgtgaattgactacctgtggaaatgtgaccaattagtgtgaaatgcatgtttagcaagtgttaggtactgtatttgaaccaataaatgtgaatccttctgca

SEQ ID NO: 317317 - DNA, 1677 bp, Homo sapiens
agttcccttgcactcccctctgcctttgcaactgatcatcctccctttctccttggcttgaagcatctatgtccagtatctgtgaaatgatgttttatctgtgtgtcaggatgagaaacggcagtcattccaccaagtgttggaaactggttagcctggagacaagggtttctggggccacagctcagggatgtgtatttaattacaggatccccagaaactcctctctaggctgccacagcaacattttttctgggcttgggagccatacctgaactgtttcctccaaggcgggaactccagagagcctgccaagtctggagcaagctggggcttctgctttggccagacctgggccaccatgagacttgaaggcttctagctgtcctacgacacgagccacggtggccctgcctctccccgctcatagaagcctggtccctctgtctagcccagttcccatctagcatccgtcttctgggcctgaagccctaaatggaccacagcctgcacaggaatcaactgtaggctcaaagggaggcggtgagtaaggtcagagcctgctccaagcccaagaacaaaagttgtgttatgggtggaggctagtcccccagatctagccctgccgtctttgccctttaatgaccattgttttctttctctaaaatgtcttgtaataggtgataatgttgttgattcaaatttccatgaaaaagaaaaaaaaaactacctcttaagcgacatcctggtcgattcctctctgaggaatcctgtgggaaaagaatactgtagctcctgctctgtttacatgtttctgtcgggaaagaagccccgcctgccctggggtgttggtgtttttgtctgtgttgccatcccaggtctgccataggggctggtggctgcattgtgatgtctgggctgtgtctggggattccttcccacctacccagccagggactagtcacccccctgaagaggcctccatttccttcctgtgctccagggcatagggagcaccactcccacagacaccacctttaagggctctagtggcacacacatccacgagcctacccccaggttacctgccctaggtccacctccacccacagtcctgtgtgtaggaatcgaggaaacgggatgtccctgagcccttgtctccaaagggccggccaagggctgcccgccagcctgactccatcaaccctccatgaccaaatgatagctggcgggctctgcaggctacccaggccctctgctacctcccaccctgccagctggcaagggatgggccctgttctgtgaattgactacctgtggaaatgtgaccaattagtgtgaaatgcatgtttagcaagtgttaggtactgtatttgaaccaataaatgtgaatccttctgcaaaaaaaaaaaaaaaaaaagaaaccagaccatacacaagacgggggagcgccgctgaatagagaacccggaaggggcgccaaagtaatcggggtcaccaccctttgtgcaaacaacggggggccccctaagggtaggggccgactcatacagcgagcacgtcgcgcgggtaaacaaggtacaggcgtagcacacacgcaacagggaacatgtggaaagagacacaatgagggggcagaacagggcaacacacagcaagattagacagccgaggaaa

SEQ ID NO: 317318 - DNA, 761 bp, Homo sapiens
  misc_feature (20)..(20): n is a, c, g, or t
  misc_feature (23)..(23): n is a, c, g, or t
  misc_feature (26)..(26): n is a, c, g, or t
  misc_feature (104)..(104): n is a, c, g, or t
ctcgtggtgcgtggaactcnagngtnctacataggccaggactgcagagaaattccagagcaccttggcagggactgtggacatttcgcaaagaggcttgatcngagctttaaccttctgaggtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317319 - DNA, 748 bp, Homo sapiens
acttatttgtcccatggatggctgctctttcttgcctgttggtctgagatgcctccgagctgctcaaagggacttctttggcctgggaattctgactcttcttcttaaagtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317320 - DNA, 728 bp, Homo sapiens
aaactctccttgctcgggtctcatgccacgctatttcatcaaggaataggaagctgaattgggaacttgtgggaagccaggaggagaaagtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317321 - DNA, 900 bp, Homo sapiens
  misc_feature (1)..(1): n is a, c, g, or t
ngttgaagaaagaggatctggctgaaagacccgcaactttcacttgttgagaacctttagccagcgccggcgtgcatgtgttttagttttattctttttcccttgcccccaaagccgtggagtacctgctgttgctctcatgcctcttgccaacagtggcatctgctcagtgtagccatcaagaatttgaatgtcaatatctttgccttgaaatgaatggaaaagtatttgtcactcagcggcaatcattcttcaaataaagtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317322 - DNA, 361 bp, Homo sapiens
tgcagacgtggaaatgttggcatgtggatagaccctgtaccaaaaacccagcagaagattcagagtccctgagatgcttcctcctcatcttcttcgccaagcacctcttgtcactgatcttggaagttagaggtgggaaaaggcaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaggtatgcgtgccggtttttcctgcaactaataccattacaataacgcgactctgtgtgtttcgcaa

SEQ ID NO: 317323 - DNA, 924 bp, Homo sapiens
acttatttgtcccatggatggctgctctttcttgcctgttggtctgagatgcctccgagctgctcaaagggacttctttggcctgggaattctgactcttcttcttaaaaatcgacgggatttctctggctgtcgtttgcgctgcatttatccgaatacatccacgctcgcaggcgatcctgcaagaaacggctcccggctcgtcgtgtacgccgtacacgctcggccaacgcaggactcgaggtggtttctatgtgcccgggtggctgccaagtctgccctccgagggaggtctggacatgcggcgcccccaggtcgagcggctctcgctgcctggcagtgcctggcaggccccacctctgccagttgcttcggaatacccgcctggtccatgggttcgcccgcggtgaaaaaatgacaagcaaattccccaacagaggtagccggaactttcctcgacgaaggctccctcctgcgcctgtgtctggagaacccccatgagcgctgcagttagcaagagagattcgatggcggtctggaaggcgcacgaagggtggggcgggggagcaaggaggccactgggtgacccagcctggtccggtgtgaaacgctagagaagggcgccttgctttccttgtttcaatgcaactcctcggcccgagacggtatcacatagtttccaggctgcgcggacgcgccgatgtgtttgcgagatcccactgggaggaggcgttcgttaaagttgcggaagttggcggaagttcgccggggggtccaaaactggggcgtcctgtcttgggcggtgcccattgctggtgacccgccgtttgtgtccctggcgggtttattgcgcgcggatcggcggcaggggcgagttaaccgggcgccgccagggggggggggtcctgcccaccccgggtgtga

SEQ ID NO: 317324 - DNA, 727 bp, Homo sapiens
  misc_feature (1)..(1): n is a, c, g, or t
ngttgaagaaagaggatctggctgaaagacccgcaactttcacttgttgagaacctttagccagcgccggcgtgcatgtgttttagttttattctttttcccttgcccccaaagccgtggagtacctgctgttgctctcatgcctcttgccaacagtggcatctgctcagtgtagccatcaagaatttgaatgtcaatatctttgccttgaaatgaatggaaaagtatttgtcactcagcggcaatcattcttcaaataaaaggttagccagacaggacccttaatcaaagagtcggtcttttctgtcagcagtgccttttaaatagcaatgatgaaggctggctgtcagggtaggacttgatgagcgagatgattgatctgcataaatcattttcttttaacattgtcagtgaagagtaaattggtgggacattttgggtattagctgtgttgaaattaatatgcagtatcctaggtgtgtcctcgatcacatagtcctcataaaagaaggtagaaattaaaaggaggcttttaggcatgcattgttctaacaagaaagttgcaccattcttactgctgtggtcatcatcttgcatgctaaattcggaagttgagtgtgtagcacattttacaagctccaaaaggaatctagttaatttgggaattagctagagtcagtagcatttaacaaccagtaaatctgtaaagacttactgctcagaggca

SEQ ID NO: 317325 - DNA, 578 bp, Homo sapiens
gctactactactaaattcacccccgtccatcaagaatttgaatgtcaatatctttgccttgaaatgaatggaaaagtatttgtcactcagcggcaatcattcttcaaataaaaggttagccagacaggacccttaatcaaagagtcggtcttttctgtcagcagtgccttttaaatagcaatgatgaaggctggctgtcagggtaggacttgatgagcgagatgattgatctgcataaatcattttcttttaacattgtcagtgaagagtaaattggtgggacattttgggtattagctgtgttgaaattaatatgcagtatcctaggtgtgtcctcgatcacatagtcctcataaaagaaggtagaaattaaaaggaggcttttaggcatgcattgttctaacaagaaagttgcaccattcttactgctgtggtcatcatcttgcatgctaaattcggaagttgagtgtgtagcacattttacaagctccaaaaggaatctagttaatttgggaattagctagagtcagtagcatttaacaaccagtaaatctgtaaagacttactgctcagaggca

SEQ ID NO: 317326 - DNA, 553 bp, Homo sapiens
tggctaggtacgaggctgggtggttgctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317327 - DNA, 846 bp, Homo sapiens
  misc_feature (1)..(1): n is a, c, g, or t
ngttgaagaaagaggatctggctgaaagacccgcaactttcacttgttgagaacctttagccagcgccggcgtgcatgtgttttagttttattctttttcccttgcccccaaagccgtggagtacctgctgttgctctcatgcctcttgccaacagtggcatctgctcagtgtagccatcaagaatttgaatgtcaatatctttgccttgaaatgaatggaaaagtatttgtcactcagcggcaatcattcttcaaataaagtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317328 - DNA, 783 bp, Homo sapiens
gctactactactaaattcacccccgtccatcaagaatttgaatgtcaatatctttgccttgaaatgaatggaaaagtatttgtcactcagcggcaatcattcttcaaataaagtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaacgatgcgcccgaaacctcatcaatcgactgcaggctcccggatccgcaaata

SEQ ID NO: 317329 - DNA, 783 bp, Homo sapiens
gctactactactaaattcacccccgtccatcaagaatttgaatgtcaatatctttgccttgaaatgaatggaaaagtatttgtcactcagcggcaatcattcttcaaataaagtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaaccggatgcggcagttcgtttttctttccaatatcggtgccaccacggccca

SEQ ID NO: 317330 - DNA, 785 bp, Homo sapiens
gctactactactaaattcacccccgtccatcaagaatttgaatgtcaatatctttgccttgaaatgaatggaaaagtatttgtcactcagcggcaatcattcttcaaataaagtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaactgatgcgcccgcgttccctacagctgaatccaccacgacatccaccccccgcc

SEQ ID NO: 317331 - DNA, 885 bp, Homo sapiens
  misc_feature (20)..(20): n is a, c, g, or t
  misc_feature (23)..(23): n is a, c, g, or t
  misc_feature (26)..(26): n is a, c, g, or t
  misc_feature (104)..(104): n is a, c, g, or t
ctcgtggtgcgtggaactcnagngtnctacataggccaggactgcagagaaattccagagcaccttggcagggactgtggacatttcgcaaagaggcttgatcngagctttaaccttctgaggtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaagatttaaatattccagtgttgagaatccacagtaaacttgctgtactctgtcactgttgaggaatgggacattcacatgaatcaaatatgctggtaaataaagaaatatggagaaaaatatagaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317332 - DNA, 549 bp, Homo sapiens
gaggaggtggtgttcaatgggaatcacaaaggctatggtagaagtgagtaatgagagctgggctcgagccctggtctgagttcagtgtggatgtttaaaggcgaccattcttaagaggcaagagaattcgatactgggttcaaatctcaattttattttaaaagtgcatcagtaacttgtagctcatttgatggcctgcagcccagcttgtttagaaatcccttctattctctctggtactccaagtcccaaagaatctgttctgatggtgtggttacacaaccagccaagcacagccttaggttgctctcaactcagaactcaccctatcacacgttgacgaatgcaagagcctgttagagacactggaacccaagatggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317333 - DNA, 983 bp, Homo sapiens
  misc_feature (20)..(20): n is a, c, g, or t
  misc_feature (23)..(23): n is a, c, g, or t
  misc_feature (26)..(26): n is a, c, g, or t
  misc_feature (104)..(104): n is a, c, g, or t
ctcgtggtgcgtggaactcnagngtnctacataggccaggactgcagagaaattccagagcaccttggcagggactgtggacatttcgcaaagaggcttgatcngagctttaaccttctgaggtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaagatgaagtttcattcttgtcgcccaggctggagtgcagtggtgcgttctcggctcactgcaacctccgcctccccggctcaagcgattctcctgtctcagcctcccaagtagctggaaatacaggcatgtgccaccatgcccagctaattttgtatttttagtaaagatggagtttcttcatgttggccaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaacgatgcgcccgaaacctcatcaatcgactgcaggctcccggatccgcaaata

SEQ ID NO: 317334 - DNA, 884 bp, Homo sapiens
  misc_feature (20)..(20): n is a, c, g, or t
  misc_feature (23)..(23): n is a, c, g, or t
  misc_feature (26)..(26): n is a, c, g, or t
  misc_feature (104)..(104): n is a, c, g, or t
ctcgtggtgcgtggaactcnagngtnctacataggccaggactgcagagaaattccagagcaccttggcagggactgtggacatttcgcaaagaggcttgatcngagctttaaccttctgaggtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaagatgaagtttcattcttgtcgcccaggctggagtgcagtggtgcgttctcggctcactgcaacctccgcctccccggctcaagcgattctcctgtctcagcctcccaagtagctggaaatacaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317335 - DNA, 377 bp, Homo sapiens
atacaccccaaagaactgaaaacaagaactcaaacagatacttgtacacctatgttcatagcagccttattcacatggacaaaagatgaagtttcattcttgtcgcccaggctggagtgcagtggtgcgttctcggctcactgcaacctccgcctccccggctcaagcgattctcctgtctcagcctcccaagtagctggaaatacaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317336 - DNA, 307 bp, Homo sapiens
tcatatcttcatcaccgtgtaggtaatgggtgtgaatctctgtgtgctcatatacatatgcttgattatatgatcatctcgtggaggacatgtgacacgggaagacaatagggcacatgatatgctctttgatctaaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317337 - DNA, 362 bp, Homo sapiens
tgcagacgtggaaatgttggcatgtggatagaccctgtaccaaaaacccagcagaagattcagagtccctgagatgcttcctcctcatcttcttcgccaagcacctcttgtcactgatcttggaagttagaggtgggaaaaggcagccccagccctgagattgctccagcctgttcttcacctgcagtgccaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317338 - DNA, 259 bp, Homo sapiens
tgaacctgcaggaatgtcagctgaaataccttgctcttttctacacatttctgaatcagccaagatgtcagtgacctggaaaggactcaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317339 - DNA, 217 bp, Homo sapiens
atactaacccaaaatacactaaaacaaaaacaacccaaccttgatgtggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317340 - DNA, 234 bp, Homo sapiens
  misc_feature (59)..(59): n is a, c, g, or t
  misc_feature (71)..(71): n is a, c, g, or t
tatatcacagatacatcagcttactacttaatattcccccacaaaaaccccaaccctangtagtacccganggcaagtgctcttctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaaaaaaaaaaa

SEQ ID NO: 317341 - DNA, 1759 bp, Homo sapiens
gctgtggcgtgcgtggagcccgaggcctcagctcccacatcgggctcttcattgaatctcctctttgcatactcatcccagcagctgcatcaaaattctgcattttaacttaaatgacgcgggactctatacgttatacgcgttaaaaaatgtagtaaattgaaagcagtgagaaaggtaattgctttgagtgctgtttaaaaattgaagtaaaatctcattcatttaagcagttaatgtcagcttattgtgggggttacataaattagcatctttttagtttaaaagagaaatttgcttcaggggtttttcattgttcttagttcaaggacagttatctccagtgcaaagtcatgatcacatatgattgatgttattagcttgctgcttgagttactgttcagaaaaactacactttgtatattatgagaattagtggtcactgttgagcaaaacttctagagctttcttggcatgcctgttgggaagagaataaaaatgtgtcatcagagtacaggtgacagagtgcacccagcgccatgccccacctccctcttccagtcctttggcccacctgcggctcctgcctgctgtctttcttccggatcatctgcctggcccaccccactcacctctcttcttaaaacttaaatgtgatcacatcactgacctgcctacagcctccttttccctggggaataacgttcaaaggcctccctctgccattcacagccctgtagtctggcctcatcctgatttcgggggtctttcgatgctgtatagccctgcatcccctccggtgtgggcccgggcagacgtgcacacctccgcacacgcctctggctcactcaccaccgttcatgcctctgctgtgctccgtgtctgttgctccttccatgtggggcggggtgtcctccttcatccccatgataccccgcaggtcagatgtcctcctttctgtgaagcattctcaggtcagaactaattctgaccaagggacccaaggcagttatcctggcgttaaagtcctggggtgttaaaagggggctcagtgttgaaaaggaactcacaggttcctactcacagactctctcagtaggacattgatgacacactggtaccaaccacatccttaggcctttctctgaggactgaagttctgcttcgcatttgactttatctttgttgttttatttctctgagagattatatgtttccagtattgtagcacaggacttcacctagaaaaagcacctacaaatgctaactttcttttgaataataagatcattggtgttttttgctctctttagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgctt

SEQ ID NO: 317342 - DNA, 1886 bp, Homo sapiens
gatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgctt

SEQ ID NO: 317343 - DNA, 1967 bp, Homo sapiens
gatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaacccgtaagtgtgactctgtcagcttgcagatttcactggactttttttaacaaaggaagacttacatgaacctttgtctttcagcgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgctt

SEQ ID NO: 317344 - DNA, 1822 bp, Homo sapiens
gatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgctt

SEQ ID NO: 317345 - DNA, 1861 bp, Homo sapiens
actgttgactaagcttcgttactgggccctggaagcgaggtcagagctggaaatggccttaggggtcacctagggcctaatccatcgtttctcttgtgggggaactgagcctctgggaagggtcacattgcgttaatgcagtgtgtgtcgcctctgtccctcccccttacacgtctggcgtctcgtcagatacatgtcagctcctgggagaagctttccctggccgctttgcagaagggcgtccccttttagcctcttccacgtcaacctgctccatttctttcgtagcagttaccagtctctgaaactaagtctgtttctgtcttagcccgccaagtatttattgtatacgtatataggtgccaccgtacaggcagtacttctccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgctt

SEQ ID NO: 317346 - DNA, 1833 bp, Homo sapiens
gatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgctt

SEQ ID NO: 317347 - DNA, 2525 bp, Homo sapiens
gatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcgggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgcttcccgagcttcctttgtccttttctccccttgcccaccccgtaacctcaggaacatgcgtcctgcccagcatcagcgtggggttttgagttgagatttcagacaccctctgggaaatgcggcaaccttaggggaaagggagtccccagctgcgctcacttctgctgcgcggaacggcagcctctgtgagccctggtgggcagagtttgaatgtgtttttccttgcttccctcattcccatcttcaaaatccccagtgctttctggccttgctgctcagatttccgagtgactcaaatggggactgttacttgtgctgggtgacaggccatttgtgggtaacctcctaaggcccaagtgggtgacacttgcgtgactttcaagttagaacccaagccccctgcatgggaattgccctgaactcttacccaccccggtcccctgcatgggaattgccctgaaccctcagtagtggttgtttggctgttcttttgtattttgtgtaatttaaaattcctggttggtaagtattcaaaatgaaattcagctgggctgagaaaaagtgtgacttttgggtctgtcactgtatttctcacctgtgatctcaaatgcttcttaggcctttctgtttggactaatgtgtgaagtctgacttgctgagtgtaaaattctagtatcgatagtgttgtaagatgtgtttgcctactcataaaaaacaatgaaaataaaattttctactggaagagacaaaaaaaacaacaacaacacaaaaaaaacacacaaaaaacaacacaaacaaaaaaacaaaaacaacaagagagaagacgaaagccacacgcacaaaaagaaacaaacaacacacgacgatgggtggggcgggcgacgcgacggcgcaggcaagaactgattgccaaaccacacgagggggaagaggcggaggccggcacgacggtgagacacgagagaggacacgacaggacgacccacacaagaaagaccgacggccgagcgacacaccc

SEQ ID NO: 317348 - DNA, 889 bp, Homo sapiens
acttaagtgctaagtacgaggctgggtgttaatcggccgagggaatctccactgaatatcatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgctt

SEQ ID NO: 317349 - DNA, 854 bp, Homo sapiens
aaggaggttttcacatgttgtttaactccagtaaagtctgatccagcatctgatgcatactaaggttttcttctttggcatagccactttctcttctaagtcatcaatgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgctt

SEQ ID NO: 317350 - DNA, 1028 bp, Homo sapiens
gatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgtaagtgctccttaaatacgtgttctagaaatcatctctctttgtatggccaaggttagctttagctccgttgtttcccaagtaaatgaatcagttggacttatttatggccttttttgagaaatcaatttagggggtgtgaacccttctgaatggcagacattattcttacacccgtttttgttaggaaagcacaatcatatgtgttgctcgaaattttctactttagttcagtctcttgaagtttattcccaaatcaaatatcatattcatccagagtgaacattatacccagtggcacacaccaacaaattccctttcttggcatcctgacagtgttcctcaggcatgtatgaaactttttcaacattaaataatagcacagatttgcctagatacttactcatcatgta

SEQ ID NO: 317351 - DNA, 1849 bp, Homo sapiens
gatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcctgctgcgggttctctaagggaactgagactcaatgaagtcggatctcgaggggatcatgagcagcagtgtgtacttgacagcgttgggagggaactgctgatgagccctgtggtgttttataataaaatactttgaagatggcctaactccatcttctccaactc

SEQ ID NO: 317352 - DNA, 2902 bp, Homo sapiens
gatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgcttcccgagcttcctttgtccttttctccccttgcccaccccgtaacctcaggaacatgcgtcctgcccagcatcagcgtggggttttgagttgagatttcagacaccctctgggaaatgcggcaaccttaggggaaagggagtccccagctgcgctcacttctgctgcgcggaacggcagcctctgtgagccctggtgggcagagtttgaatgtgtttttccttgcttccctcattcccatcttcaaaatccccagtgctttctggccttgctgctcagatttccgagtgactcaaatggggactgttacttgtgctgggtgacaggccatttgtgggtaacctcctaaggcccaagtgggtgacacttgcgtgactttcaagttagaacccaagccccctgcatgggaattgccctgaactcttacccaccccggtcccctgcatgggaattgccctgaaccctcagtagtggttgtttggctgttcttttgtattttgtgtaatttaaaattcctggttggtaagtattcaaaatgaaattcagctgggctgagaaaaagtgtgacttttgggtctgtcactgtatttctcacctgtgatctcaaatgcttcttaggcctttctgtttggactaatgtgtgaagtctgacttgctgagtgtaaaattctagtatcgatagtgttgtaagatgtgtttgcctactcataaaaaacaatgaaaataaaattttctactggaagagacaaaaaaaacaacaacaacacaaaaaaaacacacaaaaaacaacacaaacaaaaaaacaaaaacaacaagagagaagacgaaagccacacgcacaaaaagaaacaaacaacacacgacgatgggtggggcgggcgacgcgacggcgcaggcaagaactgattgccaaaccacacgagggggaagaggcggaggccggcacgacggtgagacacgagagaggacacgacaggacgacccacacaagaaagaccgacggccgagcgacacaccc

SEQ ID NO: 317353 - DNA, 1512 bp, Homo sapiens
actgttgactaagcttcgttactgggccctggaagcgaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgctt

SEQ ID NO: 317354 - DNA, 1658 bp, Homo sapiens
gatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcaggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgctt

SEQ ID NO: 317355 - DNA, 1215 bp, Homo sapiens
gatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcaaaatgagcctgtttggaacaacctcaggttttggaaccagtgggaccagcatgtttggcagtgcaactacagacaatcacaatcccatgaaggatattgaagtaacatcatctcctgatgatagcattggttgtctgtcttttagcccaccaaccttgccggggaactttcttattgcaggatcatgggctaatgatgttcgctgctgggaagttcaagacagtggacagaccattccaaaagcccagcagatgcacactgggcctgtgcttgatgtctgctggagtgacgatgggagcaaagtgtttacggcatcgtgtgataaaactgccaaaatgtgggacctcagcagtaaccaagcgatacagatcgcacagcatgatgctcctgttaaaaccatccattggatcaaagctccaaactacagctgtgtgatgactgggagctgggataagactttaaagttttgggatactcgatcgtcaaatcctatgatggttttgcaactccctgaaaggtgttactgtgctgacgtgatataccccatggctgtggtggcaactgcagagaggggcctgattgtctatcagctagagaatcaaccttctgaattcaggaggatagaatctccactgaaacatcagcatcggtgtgtggctatttttaaagacaaacagaacaagcctactggttttgccctgggaagtatcgaggggagagttgctattcactatatcaaccccccgaaccccgccaaagataacttcacctttaaatgtcatcgatctaatggaaccaacacttcagctcctcaggacatttatgcggtacgtttttagacactttaaccgtggtaataca

SEQ ID NO: 317356 - DNA, 2797 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317357 - DNA, 2371 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacacgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317358 - DNA, 1213 bp, Homo sapiens
aaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggaaggaaggaagggaaggaaggaaggaaggaaggaaggaagaggaaggaaggaaggaaggaaggaaggaagaggaaggaaggaaggaaggaaggaaggaagaggaaggaaggaaggaaggaaggaaggaagaggaaggaaggaaggaaggatggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317359 - DNA, 2155 bp, Homo sapiens
taatctgggaaaccggctccattctgggtctgagttaggagcttggggctgtagtggggagctaggagtcccattggaaggggcctgcagcgacaggctgtggatgcgcacaggctggcccatgcggcccgtgcagcaggcgccacataagccagatgtcagcggccgagagcccgtgcactacaaccagctcacggtaaaagcaggggtcgaaggtgctcaaatgcggcgcggctgaaggctgggggatgccaaaggtgcggaaggcagggtgaggctcgggcgtgagccgcaggcgctgcagacacatgcccagaaagacgtcgtcgatggggaagagctcgacctgcgcacaggcgccagccaggcggtgcagcgtggccccggaaagcacaaagccaccgccgcccgcgtaggccggataggcgggcaggccgtacacggcctcggggatgtagtacttgctagcccgcgtgcggatgggccgcgcatgcacaattacgtcaccagcaagcaggtcttgcgccgggtcccgcggcgccaggaactccaggagatttcccacgttcacgaacacatctgcgtcgcccttaaaaacgaagcgcacgtcggggcagaaagctgaggcccaggctagaaagtggatctccttgagcgttaggttaaaaaaggtgtcgtcgaaggcccagagcaggatgtccgcatacgcaaggctctcggcccgcagcagggcgcgccagtgggttcgcgcgccctccccaacttcgtcggccccgcccgagcctgcgcccctgggcacgcccagcaagaacacgcggcgcaccagcgccccctgcacgcgaccctccgcgccccacgtctggcgcacggcttggcgccgctcgaagtcctctgccaccgacttgacagcaataagcaggtccgggcggccaccgggtgcgccgtcgccgcggcacttgtgcggctggttaatgagcagtggaaaccgccgctggtccttggcgcgcaaatagcgggcgaagtcaaagggtcccgtaggcgtgggcggcgccggtgtgtccccttcgtaggccggcggggctgcacccgcgtcgggtaactggaacgcgcggggtccgggggtgggcctcggtgccgccctccctcgccctcgcggcgcgctcgccgtcggggccgcgccgtcgcgctgcgcatagagtaagaggcccagggaggcgccaaggagcagcgtgagcaatgcgtccctgcgtaggcgcagcctcctcctcatctccgcgcggcctgcgccctccctcccctgtaagggtcgcagtcggcagcagggggcagcgagccccgccctccccagctgagggggcgggaggccacgccccggggggggctccagcgaccgacggttgagccccttgcgttgttctcctcctcccggccgtgtcgcaccgccgggaccggcagcctgaagggacaagaagttcacccatgtagccaactcccccgcggcctcagctccggcccaggactgcgacccagggccgggcagggagactgggagcctcggcccctcccccgcccgcctccctcgcgctgaggccgaatcccttccaccctgccatcccctcaatgtcgggccctggggtcccgacactcacgctcggccctcggaagtggcgcagccccggacgccctggcctccggggctcagcgcagggtccgaggggccgccatggaccgggcccgagccaaatgcagaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317360 - DNA, 870 bp, Homo sapiens
  misc_feature (1)..(1): n is a, c, g, or t
  misc_feature (32)..(32): n is a, c, g, or t
nctccgtcccaacttaggctaggtacgaggcngggtggttaatcggccgaggcgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggcgtcctgggcgtcgggccggggcctccagggggcggcccaggtgaggcactcttggtggcagtgccgttcgttggtgccggactcccccggtgcgtgacgaggcgc

SEQ ID NO: 317361 - DNA, 2815 bp, Homo sapiens
  misc_feature (1)..(1): n is a, c, g, or t
  misc_feature (32)..(32): n is a, c, g, or t
nctccgtcccaacttaggctaggtacgaggcngggtggttaatcggccgagggtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317362 - DNA, 2832 bp, Homo sapiens
  misc_feature (2808)..(2808): n is a, c, g, or t
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagccccaaaaaaaacacnaacacataaaacacaaaacacagg

SEQ ID NO: 317363 - DNA, 2614 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317364 - DNA, 2778 bp, Homo sapiens
agcgtggggaggggcactctccaatgcgctgcggcccggagtgactggggccgcggctgccaccgccacacgcggtgcgggcaccacgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317365 - DNA, 3446 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagccccaaaaaaaaaaaacaaaaaaaaaaaatccggggccttaatgccgggggggggaacaaaggggtcacggaatgggcccggggccataggcggatacaacagaccaagttttctggacacacgggggacaacacacgccggaacaccaaaaacgggagcggaataaagccagaaaacaccaggtcaccggcttaatgagacgcgacaaaaggaagagagaacccagacacaacaagaacaacaagagacaaacaacaacgacacaacaaacacacacagaaaaacaaaacaacacacaacaagacaacaccacaaacacacacaaccaacagacacaatacaccaacacaaccctcaccacacaggacaagagaaaaaaagaacaaggaaagcagcagcacagaggaacccgaggcgacgagaacgacagacagagagaagacaaagcaaaagaagcaggagaagccagacgagaaacagacggacagtaacgagcacgacacggaggagagccagaggagaggagagagcaagcacaaggcagaccaagagaagagagacagaaaaggggacggaagagagcaaaagaacaaaaaggagcggaacggaggtacgaagaaaaaggacaaaaagaagagcaaggacgaaaggcg

SEQ ID NO: 317366 - DNA, 2922 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagccccagcgccagaagaaaatatggaaatatatgactaatcatcatgaaagatgaaaatattcacaatctcatgaacatgcaagcacagaaagtttaactaggaagcaggaaacaacgtcaggaccccatt

SEQ ID NO: 317367 - DNA, 2818 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcccttgcatagctaattgcgcccggccaaggagcttttgactggccatcatcccctgacctaccttagtgttggtacagcagcaagcgacaccaaaaaaaa

SEQ ID NO: 317368 - DNA, 2753 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317369 - DNA, 1859 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317370 - DNA, 2273 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctaggacagccactggcgaggctaggacagccactggcgaggctaggacagccactggcgaggctaggacagc

SEQ ID NO: 317371 - DNA, 2108 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgaccgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317372 - DNA, 2061 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317373 - DNA, 2017 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317374 - DNA, 2443 bp, Homo sapiens
  misc_feature (1)..(1): n is a, c, g, or t
  misc_feature (32)..(32): n is a, c, g, or t
nctccgtcccaacttaggctaggtacgaggcngggtggttaatcggccgaggcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317375 - DNA, 2855 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagctgctgagtgttgccctgtgtccctgacttgcctagtttcgctcccatcctggttgtgcctgccactggacctggaactgtggtctgcattgtggttctgcgttgcgatggtcctgatgtgctgacacctgtgctggctagcttctgtgctgtgcacctgatggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317376 - DNA, 1607 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317377 - DNA, 1374 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcagggggactcaagaagcttcttcccctccaagttgaaaggcttccattcaaaacgcgggcccccaattccattcggtgttaccagccgggggaagctagtggttcaatcggggctgcccgcaaagggtcca

SEQ ID NO: 317378 - DNA, 1145 bp, Homo sapiens
tagctggagcggtgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccacggcacggggcgggaaccacgctcaaaaagcaccgcattgcatatggggacgc

SEQ ID NO: 317379 - DNA, 1480 bp, Homo sapiens
  misc_feature (1)..(1): n is a, c, g, or t
  misc_feature (32)..(32): n is a, c, g, or t
nctccgtcccaacttaggctaggtacgaggcngggtggttaatcggccgaggcgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317380 - DNA, 1671 bp, Homo sapiens
gctggctcgaactcctgacctcaagtgatccgcccacctcagcctcccaaagtgctgggattacaggcgtgagccactgcggccgagcagaacacgttctaggacccttgttcatgtgtccatcatggacaggaggacgtgcgggccatagggaccctggctcattccggagccgggactggagggtggggcgtcacccttgggaacacccgtgcccaccctccgctgcccagggtaggggtggggagccaggctttgggccccacttgataaagtcccctccccagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 317381 - DNA, 2469 bp, Homo sapiens
gccggacgttgtggctgaagcctgtaatcccagcggtttaagaggccaaggcctaagcccaggtgttggagaccagcctgagcaacacagcgcaatgtgtcatttaggcctgtgacgtcggaactttattatttgaacatttaaaaataaatgaatccaagagcttgagtcacttggccaaaaatgcccaggaggaaaaggccaagtcaggtaccccggctctagagctactaactgatcgccggagaccctgggccttggaagaagtcgcctccccagatctctaagcaggccgcgcgaccctcgagtctcaggtaagcgggaaatcccacttcacaagaaagcccctctctccgaggcacgggcgcatgcgcgggtcggccacccgctggggccgcggggccgccgctctggcccgcgtggggcagtcgtccgcgtctcgctcatgatgacgcacgtccggggcggtgggggaaggcaagatggcggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacacgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagccaaaaaaaaaaaaaaaaaaccaaaaaaaaaaaaacacataaacacaacacacaaaccacacagaacaaactacacacatacaatcatccctcacaaactccgtcaccaccccacaccaatcattcatctctaatacacattcccactccctcctgctcaccctctctcccctcactccaccccttcctctctctctactcctccacctcgttgctctggtcaccacaccgccctccctctcctctgcttaactcactcctcctccactccccacccccctccaacaagtagagatatctctcactctccttttctctcgaccactagtcttctcccctctctcgtccccacagctccccctatcctctctcatagtctcttccctccccctcaccacctcccctctccttctctcccttcccctctttccctcctcttctcttcccatttcactcccttcgctctcacccccacca

SEQ ID NO: 317382 - DNA, 2400 bp, Homo sapiens
gccggacgttgtggctgaagcctgtaatcccagcggtttaagaggccaaggcctaagcccaggtgttggagaccagcctgagcaacacagcgcaatgtgtcatttaggcctgtgacgtcggaactttattatttgaacatttaaaaataaatgaatccaagagcttgagtcacttggccaaaaatgcccaggaggaaaaggccaagtcaggtaccccggctctagagctactaactgatcgccggagaccctgggccttggaagaagtcgcctccccagatctctaagcaggccgcgcgaccctcgagtctcaggtaagcgggaaatcccacttcacaagaaagcccctctctccgaggcacgggcgcatgcgcgggtcggccacccgctggggccgcggggccgccgctctggcccgcgtggggcagtcgtccgcgtctcgctcatgatgacgcacgtccggggcggtgggggaaggcaagatggcggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacacgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagccaaaaaaaaaaaaaaaaaaccaaaaaaaaaaaaacacataaacacaacacacaaaccacacagaacaaactacacacatacaatcatccctcacaaactccgtcaccaccccacaccaatcattcatctctaatacacattcccactccctcctgctcaccctctctcccctcactccaccccttcctctctctctactcctccacctcgttgctctggtcaccacaccgccctccctctcctctgcttaactcactcctcctccactccccacccccctccaacaagtagagatatctctcactctccttttctctcgaccactagtcttctcccctctctcgtccccacagctccccctatcctctctcatagtctcttccctccccctcaccacctcccctctccttctctcccttcccctctttccctcctcttctcttcccatttcactcccttcgctctcacccccacca

SEQ ID NO: 317383 - DNA, 2013 bp, Homo sapiens
  misc_feature (26)..(26): n is a, c, g, or t
aacttcggctaggtacgggctgggtntgaatcggccgaggggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacacgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagccaaaaaaaaaaaaaaaaaaccaaaaaaaaaaaaacacataaacacaacacacaaaccacacagaacaaactacacacatacaatcatccctcacaaactccgtcaccaccccacaccaatcattcatctctaatacacattcccactccctcctgctcaccctctctcccctcactccaccccttcctctctctctactcctccacctcgttgctctggtcaccacaccgccctccctctcctctgcttaactcactcctcctccactccccacccccctccaacaagtagagatatctctcactctccttttctctcgaccactagtcttctcccctctctcgtccccacagctccccctatcctctctcatagtctcttccctccccctcaccacctcccctctccttctctcccttcccctctttccctcctcttctcttcccatttcactcccttcgctctcacccccacca

SEQ ID NO: 317384 - DNA, 2015 bp, Homo sapiens
aaagcaggctgtccgccggattcgttcgtcgcacgcgtcgctggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacacgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagccaaaaaaaaaaaaaaaaaaccaaaaaaaaaaaaacacataaacacaacacacaaaccacacagaacaaactacacacatacaatcatccctcacaaactccgtcaccaccccacaccaatcattcatctctaatacacattcccactccctcctgctcaccctctctcccctcactccaccccttcctctctctctactcctccacctcgttgctctggtcaccacaccgccctccctctcctctgcttaactcactcctcctccactccccacccccctccaacaagtagagatatctctcactctccttttctctcgaccactagtcttctcccctctctcgtccccacagctccccctatcctctctcatagtctcttccctccccctcaccacctcccctctccttctctcccttcccctctttccctcctcttctcttcccatttcactcccttcgctctcacccccacca

SEQ ID NO: 317385 - DNA, 2091 bp, Homo sapiens
gccggacgttgtggctgaagcctgtaatcccagcggtttaagaggccaaggcctaagcccaggtgttggagaccagcctgagcaacacagcgcaatgtgtcatttaggcctgtgacgtcggaactttattatttgaacatttaaaaataaatgaatccaagagcttgagtcacttggccaaaaatgcccaggaggaaaaggccaagtcaggtaccccggctctagagctactaactgatcgccggagaccctgggccttggaagaagtcgcctccccagatctctaagcaggccgcgcgaccctcgagtctcaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacacgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagccaaaaaaaaaaaaaaaaaaccaaaaaaaaaaaaacacataaacacaacacacaaaccacacagaacaaactacacacatacaatcatccctcacaaactccgtcaccaccccacaccaatcattcatctctaatacacattcccactccctcctgctcaccctctctcccctcactccaccccttcctctctctctactcctccacctcgttgctctggtcaccacaccgccctccctctcctctgcttaactcactcctcctccactccccacccccctccaacaagtagagatatctctcactctccttttctctcgaccactagtcttctcccctctctcgtccccacagctccccctatcctctctcatagtctcttccctccccctcaccacctcccctctccttctctcccttcccctctttccctcctcttctcttcccatttcactcccttcgctctcacccccacca

SEQ ID NO: 317386 - DNA, 2956 bp, Homo sapiens
gccggacgttgtggctgaagcctgtaatcccagcggtttaagaggccaaggcctaagcccaggtgttggagaccagcctgagcaacacagcgcaatgtgtcatttaggcctgtgacgtcggaactttattatttgaacatttaaaaataaatgaatccaagagcttgagtcacttggccaaaaatgcccaggaggaaaaggccaagtcaggtaccccggctctagagctactaactgatcgccggagaccctgggccttggaagaagtcgcctccccagatctctaagcaggccgcgcgaccctcgagtctcaggtaagcgggaaatcccacttcacaagaaagcccctctctccgaggcacgggcgcatgcgcgggtcggccacccgctggggccgcggggccgccgctctggcccgcgtggggcagtcgtccgcgtctcgctcatgatgacgcacgtccggggcggtgggggaaggcaagatggcggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacacgctccccatcacggacctgcactgcggctttgggggccccctggcccgggtggccacctcctcactggaccagacggtgaaggtacgccgcccccaccccaccacggtccatgagcggagcccagcagccgcaggtcctcagccaggaatgcaggaatcgcctcctcccgctccctgctgtcaggactccagacggcttttaatcccctggtgctctgagcccaaggacgtccagggaggtctgccagcctggaaattcctactcattcaccgtttctggcccggctccctggccaagcctggggaatcggaggtcatcactatgcttgagtcgtgaccggtggtcctgggagggagaaccaggggtcatcagccggagaccaagctccatttcagcacaggccatgtcccctggcccccaagacccacatggtgacggctttcacccaaagtcgcaagccctagggccagaggacagccgacgcctgacctccctggtgcccctgttcccatggggtcctcgggttccccctgccgggccgagccccacgccctttgcccacccgcagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagccaaaaaaaaaaaaaaaaaaccaaaaaaaaaaaaacacataaacacaacacacaaaccacacagaacaaactacacacatacaatcatccctcacaaactccgtcaccaccccacaccaatcattcatctctaatacacattcccactccctcctgctcaccctctctcccctcactccaccccttcctctctctctactcctccacctcgttgctctggtcaccacaccgccctccctctcctctgcttaactcactcctcctccactccccacccccctccaacaagtagagatatctctcactctccttttctctcgaccactagtcttctcccctctctcgtccccacagctccccctatcctctctcatagtctcttccctccccctcaccacctcccctctccttctctcccttcccctctttccctcctcttctcttcccatttcactcccttcgctctcacccccacca

SEQ ID NO: 317387 - DNA, 1901 bp, Homo sapiens
aaagcaggctgtccgccggattcgttcgtcgcacgcgtcgctggaggtggccgtgtgtacggactcggcggccccgatgtggagctgcatcgtgtgggaacttcactcgggcgccaacctgctcacctaccgcggcggccaggcgggggaaccccccgccgggccctgggcggcttgctcaaatggcgaggtgttgtgcgcaggcagactctagctggctcagagactcagaaaatgtgccggctgactgttgtgtacatggtctctacgtctgcgatgcaagcatcactgtggagtcacggaacttgtcatctgtatacagagtcttgccttcagttcacaggggacagcgcacttcatctcagggggcaaggactgctggtgcgttggagcctctgcagcgtgctgcggccgacccctcagattccggccaggccgttggctcccccgcccctccggacctgcctgggttgggggcccctgccggtggcactcctcctgacagagggagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagccaaaaaaaaaaaaaaaaaaccaaaaaaaaaaaaacacataaacacaacacacaaaccacacagaacaaactacacacatacaatcatccctcacaaactccgtcaccaccccacaccaatcattcatctctaatacacattcccactccctcctgctcaccctctctcccctcactccaccccttcctctctctctactcctccacctcgttgctctggtcaccacaccgccctccctctcctctgcttaactcactcctcctccactccccacccccctccaacaagtagagatatctctcactctccttttctctcgaccactagtcttctcccctctctcgtccccacagctccccctatcctctctcatagtctcttccctccccctcaccacctcccctctccttctctcccttcccctctttccctcctcttctcttcccatttcactcccttcgctctcacccccacca

SEQ ID NO: 317388 - DNA, 2447 bp, Homo sapiens
gccggacgttgtggctgaagcctgtaatcccagcggtttaagaggccaaggcctaagcccaggtgttggagaccagcctgagcaacacagcgcaatgtgtcatttaggcctgtgacgtcggaactttattatttgaacatttaaaaataaatgaatccaagagcttgagtcacttggccaaaaatgcccaggaggaaaaggccaagtcaggtaccccggctctagagctactaactgatcgccggagaccctgggccttggaagaagtcgcctccccagatctctaagcaggccgcgcgaccctcgagtctcaggtaagcgggaaatcccacttcacaagaaagcccctctctccgaggcacgggcgcatgcgcgggtcggccacccgctggggccgcggggccgccgctctggcccgcgtggggcagtcgtccgcgtctcgctcatgatgacgcacgtccggggcggtgggggaaggcaagatggcggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacacgctccccatcacggacctgcactgcggctttgggggccccctggcccgggtggccacctcctcactggaccagacggtgaagtgagggctccatcttccaggtcgacctcttcacctgggtgagtgccgcggtctgcgggctgcaccctgccctggggctgagggcatcgggcctgcggctcacacacgtctcggccttcgcagcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagccaaaaaaaaaaaaaaaaaaccaaaaaaaaaaaaacacataaacacaacacacaaaccacacagaacaaactacacacatacaatcatccctcacaaactccgtcaccaccccacaccaatcattcatctctaatacacattcccactccctcctgctcaccctctctcccctcactccaccccttcctctctctctactcctccacctcgttgctctggtcaccacaccgccctccctctcctctgcttaactcactcctcctccactccccacccccctccaacaagtagagatatctctcactctccttttctctcgaccactagtcttctcccctctctcgtccccacagctccccctatcctctctcatagtctcttccctccccctcaccacctcccctctccttctctcccttcccctctttccctcctcttctcttcccatttcactcccttcgctctcacccccacca

SEQ ID NO: 317389 - DNA, 1019 bp, Homo sapiens
  misc_feature (14)..(14): n is a, c, g, or t
  misc_feature (17)..(17): n is a, c, g, or t
  misc_feature (24)..(27): n is a, c, g, or t
  misc_feature (33)..(33): n is a, c, g, or t
  misc_feature (47)..(47): n is a, c, g, or t
  misc_feature (49)..(50): n is a, c, g, or t
  misc_feature (52)..(52): n is a, c, g, or t
  misc_feature (62)..(62): n is a, c, g, or t
  misc_feature (73)..(73): n is a, c, g, or t
  misc_feature (79)..(79): n is a, c, g, or t
  misc_feature (82)..(82): n is a, c, g, or t
  misc_feature (91)..(91): n is a, c, g, or t
  misc_feature (101)..(101): n is a, c, g, or t
  misc_feature (103)..(103): n is a, c, g, or t
  misc_feature (105)..(105): n is a, c, g, or t
  misc_feature (109)..(109): n is a, c, g, or t
  misc_feature (111)..(111): n is a, c, g, or t
  misc_feature (114)..(114): n is a, c, g, or t
  misc_feature (121)..(121): n is a, c, g, or t
  misc_feature (124)..(125): n is a, c, g, or t
  misc_feature (131)..(131): n is a, c, g, or t
  misc_feature (134)..(137): n is a, c, g, or t
  misc_feature (141)..(141): n is a, c, g, or t
  misc_feature (143)..(143): n is a, c, g, or t
  misc_feature (145)..(145): n is a, c, g, or t
  misc_feature (147)..(147): n is a, c, g, or t
  misc_feature (150)..(151): n is a, c, g, or t
  misc_feature (159)..(159): n is a, c, g, or t
  misc_feature (163)..(163): n is a, c, g, or t
  misc_feature (165)..(165): n is a, c, g, or t
  misc_feature (177)..(177): n is a, c, g, or t
  misc_feature (183)..(183): n is a, c, g, or t
  misc_feature (186)..(186): n is a, c, g, or t
  misc_feature (199)..(199): n is a, c, g, or t
tcattctgtgttcntantttattnnnntctttntttttccccacttntnnangcaccttctntgctccgtgcncggggncgngccgcgccncgggttcttnantnttcncnttntcttccnccnncagttntcnnnncccntntncnttnnccgcacgntgcngnttcatgccttcnttttcngcnccatttagaagtnagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagccaaaaaaaaaaaaaaaaaaccaaaaaaaaaaaaacacataaacacaacacacaaaccacacagaacaaactacacacatacaatcatccctcacaaactccgtcaccaccccacaccaatcattcatctctaatacacattcccactccctcctgctcaccctctctcccctcactccaccccttcctctctctctactcctccacctcgttgctctggtcaccacaccgccctccctctcctctgcttaactcactcctcctccactccccacccccctccaacaagtagagatatctctcactctccttttctctcgaccactagtcttctcccctctctcgtccccacagctccccctatcctctctcatagtctcttccctccccctcaccacctcccctctccttctctcccttcccctctttccctcctcttctcttcccatttcactcccttcgctctcacccccacca

SEQ ID NO: 317390 - DNA, 1087 bp, Homo sapiens
gccggacgttgtggctgaagcctgtaatcccagcggtttaagaggccaaggcctaagcccaggtgttggagaccagcctgagcaacacagcgcaatgtgtcatttaggcctgtgacgtcggaactttattatttgaacatttaaaaataaatgaatccaagagcttgagtcacttggccaaaaatgcccaggaggaaaaggccaagtcaggtaccccggctctagagctactaactgatcgccggagaccctgggccttggaagaagtcgcctccccagatctctaagcaggccgcgcgaccctcgagtctcaggtaagcgggaaatcccacttcacaagaaagcccctctctccgaggcacgggcgcatgcgcgggtcggccacccgctggggccgcggggccgccgctctggcccgcgtggggcagtcgtccgcgtctcgctcatgatgacgcacgtccggggcggtgggggaaggcaagatggcggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcaggtagcgccttgcgcactcaggagggtggtaagggctacatagcaaggagtgtgcttaatgtgcctgagctgtgcacctagaaatggccaagatggcaggtttcatgttatgactattttcccacaataaaacattttttaaaagtctcct

SEQ ID NO: 317391 - DNA, 345 bp, Homo sapiens
cgccctccactgctgtagtagctcccgtgtcctgcatggggctcacgaggctgactgtgcatccttaggaccagctccagcagaagatcatgtgccccgggcctgtcacctgtctgactgcatcacccaatggtctctacgtcctggcaggagttgcagaaagcatccacctgtgggaggtaagaggagcaaagcgtgagcgtttcccacaggacatctcagcccatctgagctttgcctgcagggcaccagggaacaaccatgcggcctggggccctgggatgggtgactgctcaggggttatagcctaagcttcaccctgctgcctcctttctccaggtcccc

SEQ ID NO: 317392 - DNA, 1131 bp, Homo sapiens
  misc_feature (260)..(260): n is a, c, g, or t
  misc_feature (267)..(267): n is a, c, g, or t
ttggagacggagtctcactctgtcacccattctggagtacaatggcatgatctcagctcactgcaacctcctccttctgggttcaagtgattcttctgcctcagcctcctgagtagctgggactacaggcttgtgccaccacactcagctaatttttgtatttttagtagagacagggtttcaccatattggccaagctggtcttgaactcctgacctcaaacgatctgcccaccccagcctcccaaagtgctgggattncaagtgngagccaccacacccagcctaatgtaactgttttcctttccttttagtctttatctcattgttatatgtgattataatgttgtcatttatgcattcacatcaccagtaattatctcaaacagatcttaaatgctgcctatcatgttgaagtcacgtttcactcagggtcgtcagttacaaggatgctatgggagcaaatcaaacagatcatccagcgcatcacatgggtgagcccacctgccatcactctggaatggaagaggaaggtggcccaggaagccattgagagcctcagcgcctccaaattggctaagagcatttgcagccaattccggactcggctcaatagttcccacgaggcttttgcagcctccttgcggcagctggaagctggccactcaggccggttagagaaaacggaagatctatggctgagggttcggaaagatcatgctccccgcctggcccgcctttctctggaaagccgttctttacaggatgtcttgcttcatcgtaaacctaaactgggacaggaactgggccggggccagtatggtgtggtatacctgtgtgacaactggggaggacacttcccttgtgccctcaaatcagttgtccctccagatgagaagcactggaatgatctggctttggaatttcactatatgaggtgggtcctggcctcattcatctctatgagaaagatccagagaagaatctagaaccctggtttagattttgtaccaagagctacagcatggcctctctatatttagttttctgtgtctaacagacatgtgctccctttcaggcctttactgtctttgcttgctctttccccaccatcctaatttctcagactcat

SEQ ID NO: 317393 - DNA, 895 bp, Homo sapiens
aacacatatctggctcatgtgtctgatggcctgggttgtgcttcccaccaccaagctgggcagtgaggagagctgtaagcttcggcgcctccgcttcacctatgggactcagactcgggtcagcctggcgctccctggacagtatgaactagtgcacacgctggttgctcatcagggcaactgggagaccatccctgaggaggatctggaggtccaagagaacaatgaggatgctgctcatgttttagcggaactggaggtaacgatgcaccatgctctcttacaggaagtggacgttgtggtagcaccatgccaaggcctccggcccacagtggatgttctgggtgacttggtgaatgatttcttgcctgtgataacctatgcactccacaaagatgaactctctgagagggatgagcaagagcttcaggaaatccgaaagtatttctcctttcctgtattctttttcaaagtgccgaaactgggctcggagataatagactcctcaaccaggagaatggagagcgaaagatcaccgctttatcgccagctaattgacctgggctatctgagcagcagtcactggaactgtggggctcctggccaggatactaaagctcagagcatgttggtggaacagagtgaaaagctgagacacttgagcacattttctcaccaggtgttacagactcgcctggtggatgcagccaaggccctgaacctggtgcactgccactgccttgacatctttattaaccaggcatttgacatgcagcgggacctgcagatcactcccaaacgtctggaatatactcgaaaaaaggagaatgagtgtatgaatcatatgatgaatattgccgaaagcaggaggaaatgaaggatatgattgtggaga

SEQ ID NO: 317394 - DNA, 607 bp, Homo sapiens
  misc_feature (16)..(16): n is a, c, g, or t
ctagtgcgatccccgngctgcaggaattcggcacgagccttcagttatggaggtgggatgaatagagcttgtttgatgttaaagtgggtaaggagggagtggccttgagacacttgtattccaaactctcctggaggtttccagtagcactactgttcctaaaagggtttcatttttaacttcatctgttttgttaacatccagtccaattgaggtgatctcagaggtgcatcaggacatctagcactggggaggccaccttgcccagatagttgaaaagaaaattggtctgggcagcctgttgtcttttgtcttcatgtaatgttttttctttgttttaaaggactaatgtttattacagtgttaaataaaagtgtaagatactaagtgtgtagaatctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 317395 - DNA, 646 bp, Homo sapiens
gccatggggcagcgagcccgtctcgggtcccggccccggcggcggcggaatgatccgcgagctgtgccggggcttcggccgctaccgccgctacctgggacggctgcgacagaacctgcgcgagacccagaagttcttccgcgacatcaagtgctcccacaaccacacttgtctctcctccctcacgggcggcggcggggccgagcgcggccctgcaggcgatgtcgccgaaaccgggctgcaggcgggccaactgagctgcatttccttcccacctaaggaagagaagtacctccagcagattgtggactgcctcccttgcatactgatcctcggccaggattgtaacgtcaagtgccagctgttgaatctgctgttgggggtgcaggtgcttcccaccaccaagctgggcagtgaggagagctgtaagcttcggcgcctccgcttcacctatgggactcagactcgggtcagcctggcgctccctggacagtatgaactagtgcacacgctggttgctcatcagggcaactgggagaccatccctgaggcaggagaatcacttgaacccgggaggcagaggtcatggtgagccgagatcacgccactgcactccagcctgggcaacagagcgagactctatctc

SEQ ID NO: 317396 - DNA, 239 bp, Homo sapiens
tactactactaaattcgcggccgcgtcgacctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 317397 - DNA, 6385 bp, Homo sapiens
ctgagggaaagcttcgtcggaaccctggaacgatgtctgcagagcctggagaagtctcaggatgtctcagttcacatcaccagtaattatctcaaacagatcttaaatgctgcctatcatgttgaagtcacgtttcactcagggtcgtcagttacaaggatgctatgggagcaaatcaaacagatcatccagcgcatcacatgggtgagcccacctgccatcactctggaatggaagaggaaggtggcccaggaagccattgagagcctcagcgcctccaaattggctaagagcatttgcagccaattccggactcggctcaatagttcccacgaggcttttgcagcctccttgcggcagctggaagctggccactcaggccggttagagaaaacggaagatctatggctgagggttcggaaagatcatgctccccgcctggcccgcctttctctggaaagccgttctttacaggatgtcttgcttcatcgtaaacctaaactgggacaggaactgggccggggccagtatggtgtggtatacctgtgtgacaactggggaggacacttcccttgtgccctcaaatcagttgtccctccagatgagaagcactggaatgatctggctttggaatttcactatatgaggtctctgccgaagcatgagcgattggtggatctccatggttcagtcattgactacaactatggtggtggctccagcattgctgtgctcctcattatggagcggctacaccgggatctctacacagggctgaaggctgggctgaccctggagacacgtttgcagatagcactagatgtggtggagggaatccgcttcctgcacagccagggacttgtccatcgtgatatcaaactgaaaaatgtgctgctggataagcagaaccgtgccaagatcactgacttaggattctgcaagccagaggccatgatgtcaggcagcattgtggggacaccaatccatatggcccctgaacttttcacagggaagtacgataattccgtggatgtctacgcttttggaattcttttctggtatatctgctcaggctctgtcaagctccctgaggcatttgagaggtgtgctagcaaagaccatctctggaacaatgtgcggaggggggctcgcccagaacgtcttcctgtgtttgatgaggagtgctggcagttgatggaagcctgttgggatggcgaccccttgaagaggcctctcttgggcattgtccagcccatgctccagggcatcatgaatcggctctgcaagtccaattctgagcagccaaacagaggactagatgattctacttgaaagcaaagacctttctctttcactctctagttatttccttccccctcaccttttggccatggggagaatttgacatttattcactataggacacactcccaagggaactggtgcttgctgggaaacttggaaccttcccaggcagggatgactcctggacagtgaagagttgaatgactgagcatattcagcagctcactgaagcgccaagctatccctttagcaaaaaagtgtctcagatgtgtaaaagctgaggaatgtggtgttctggcttcacaaatgaaaaggaggcagatgttaccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaagaggccaggcatggtggctcacgcctgtaatctcagcactttggaaggctgaggcgggcggatcacaaggtccagagttcaagagcagcctggccaacatggtgaaaccccgtctctactaaagatacaaaaaattagccgggcgtggtggtgcatgcctgtaatccaagatactcaggaggctgaggcaggagaatcgcttgaacctgggaggcggaggttgcagtgagccgagatcatgccattgcactccagcctgggcgacagagtgagactctgtctcaaaaaaaaaaaaaaatagaatgtgtatgcatatatttgtgtgtatatgtatatatgtgtgtgtgtctatatctctatctatatagacatacacacaggagttattggatttagagttactgctaaccccagaacagaatctgttcttttacctttgagtcttttcttttgtttacctcttttcatctcaaagtgggaaagctccagataacatggtacttaggagtgagtgtctaagcaaaaccaacccaatgcgaagtatttgggtgagaactgagaggtgggagatgattggaggccatggcctatgtacaaacatactggaagaaaaccagcttgtttttaaaacttaacacaatcagaaatttttctttttgtgtttgaatctaacacactgacgtttggaaaacttgatcaatgagcttttaaccacgatttctcccgcaatttgttccttctttttacctttttaaaaatctgttagaagaaaaaaagcagcagacgaaagagaaaaaccctcctctggtagttctgtgtgtgcccctcacccctgtgtgctagtgtctgggaagtttccctgaaaggtgggaggcgggtgggtggtcttttggagggttcctcatgaagtgtgcttgaggaaagaaattctgattctaggcagaggaaggggaacaatttaaatattggtgcatctcagatgcacttgacttcaagccttcctcaaccaaactggtccattagattccgaaaaacaggtagacgaggaagtagacagtggaagtgagtagtctccctccatctgcctaatccccaataactgtggtctggcccctgtgttcagccccagagtttgtaaaacaggtccccaggtaggtgtataagatgagttgcaaattagccgggcatgctggcacgcaccagtaatcccagctacttgggaggctgaggcaggagaatcacttgaacccgggaggcagaggtcatggtgagccgagatcacgccactgcactccagccctgggcaacagagcgagactctatctcaaaaaaaaacaaaaaaaaaaaacaaaaaacaaagatgagtcgcacatctgctgctgggattttctagggttgtctatgacagaatgaccatcttttaaatattaatggagtataaatggagtctataatgggtctttcatataacttttaactctttggctatcctgggctctgatcatgatatgtttgagcatagtagctccctaaactcttggagcctttcagaaattccatgtagtgctaataacctttttacttgcaaatgataaagtaactgactcagtgtctttgggctctgcaggctttagccttgttttggtaggatgttcagtatattctcagaattttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtattttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcgactagtacctgtcagctctcaaatgcattcttgtgtctttgcttgagctgccaaagaagggtcacaaagtgttcttcctcatggaagaagtgcctcggggttgcagggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctcaaaaaaaaaaaaaagaaaaagaaaaagaaggttaatccttcagttatggaggtgggatgaatagagcttgtttgatgttaaagtgggtaaggagggagtggccttgagacacttgtattccaaactctcctggaggtttccagtagcactactgttcctaaaagggtttcatttttaacttcatctgttttgttaacatccagtccaattgaggtgatctcagaggtgcatcaggacatctagcactggggaggccaccttgcccagatagttgaaaagaaaattggtctgggcagcctgttgtcttttgtcttcatgtaatgttttttctttgttttaaaggactaatgtttattacagtgttaaataaaagtgtaagatactaagtgtgtagaataaaagtgcaataacaaaagacaatgactttggcacacacttcagtctttatcctctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 317398 - DNA, 5601 bp, Homo sapiens
gaccccagtccgatcgactgaccgggatagcactagatgtggtggagggaatccgcttcctgcacagccagggacttgtccatcgtgatatcaaactgaaaaatgtgctgctggataagcagaaccgtgccaagatcactgacttaggattctgcaagccagaggccatgatgtcaggcagcattgtggggacaccaatccatatggcccctgaacttttcacagggaagtacgataattccgtggatgtctacgcttttggaattcttttctggtatatctgctcaggctctgtcaagctccctgaggcatttgagaggtgtgctagcaaagaccatctctggaacaatgtgcggaggggggctcgcccagaacgtcttcctgtgtttgatgaggagtgctggcagttgatggaagcctgttgggatggcgaccccttgaagaggcctctcttgggcattgtccagcccatgctccagggcatcatgaatcggctctgcaagtccaattctgagcagccaaacagaggactagatgattctacttgaaagcaaagacctttctctttcactctctagttatttccttccccctcaccttttggccatggggagaatttgacatttattcactataggacacactcccaagggaactggtgcttgctgggaaacttggaaccttcccaggcagggatgactcctggacagtgaagagttgaatgactgagcatattcagcagctcactgaagcgccaagctatccctttagcaaaaaagtgtctcagatgtgtaaaagctgaggaatgtggtgttctggcttcacaaatgaaaaggaggcagatgttaccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaagaggccaggcatggtggctcacgcctgtaatctcagcactttggaaggctgaggcgggcggatcacaaggtccagagttcaagagcagcctggccaacatggtgaaaccccgtctctactaaagatacaaaaaattagccgggcgtggtggtgcatgcctgtaatccaagatactcaggaggctgaggcaggagaatcgcttgaacctgggaggcggaggttgcagtgagccgagatcatgccattgcactccagcctgggcgacagagtgagactctgtctcaaaaaaaaaaaaaaatagaatgtgtatgcatatatttgtgtgtatatgtatatatgtgtgtgtgtctatatctctatctatatagacatacacacaggagttattggatttagagttactgctaaccccagaacagaatctgttcttttacctttgagtcttttcttttgtttacctcttttcatctcaaagtgggaaagctccagataacatggtacttaggagtgagtgtctaagcaaaaccaacccaatgcgaagtatttgggtgagaactgagaggtgggagatgattggaggccatggcctatgtacaaacatactggaagaaaaccagcttgtttttaaaacttaacacaatcagaaatttttctttttgtgtttgaatctaacacactgacgtttggaaaacttgatcaatgagcttttaaccacgatttctcccgcaatttgttccttctttttacctttttaaaaatctgttagaagaaaaaaagcagcagacgaaagagaaaaaccctcctctggtagttctgtgtgtgcccctcacccctgtgtgctagtgtctgggaagtttccctgaaaggtgggaggcgggtgggtggtcttttggagggttcctcatgaagtgtgcttgaggaaagaaattctgattctaggcagaggaaggggaacaatttaaatattggtgcatctcagatgcacttgacttcaagccttcctcaaccaaactggtccattagattccgaaaaacaggtagacgaggaagtagacagtggaagtgagtagtctccctccatctgcctaatccccaataactgtggtctggcccctgtgttcagccccagagtttgtaaaacaggtccccaggtaggtgtataagatgagttgcaaattagccgggcatgctggcacgcaccagtaatcccagctacttgggaggctgaggcaggagaatcacttgaacccgggaggcagaggtcatggtgagccgagatcacgccactgcactccagccctgggcaacagagcgagactctatctcaaaaaaaaacaaaaaaaaaaaacaaaaaacaaagatgagtcgcacatctgctgctgggattttctagggttgtctatgacagaatgaccatcttttaaatattaatggagtataaatggagtctataatgggtctttcatataacttttaactctttggctatcctgggctctgatcatgatatgtttgagcatagtagctccctaaactcttggagcctttcagaaattccatgtagtgctaataacctttttacttgcaaatgataaagtaactgactcagtgtctttgggctctgcaggctttagccttgttttggtaggatgttcagtatattctcagaattttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtattttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcgactagtacctgtcagctctcaaatgcattcttgtgtctttgcttgagctgccaaagaagggtcacaaagtgttcttcctcatggaagaagtgcctcggggttgcagggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctcaaaaaaaaaaaaaagaaaaagaaaaagaaggttaatccttcagttatggaggtgggatgaatagagcttgtttgatgttaaagtgggtaaggagggagtggccttgagacacttgtattccaaactctcctggaggtttccagtagcactactgttcctaaaagggtttcatttttaacttcatctgttttgttaacatccagtccaattgaggtgatctcagaggtgcatcaggacatctagcactggggaggccaccttgcccagatagttgaaaagaaaattggtctgggcagcctgttgtcttttgtcttcatgtaatgttttttctttgttttaaaggactaatgtttattacagtgttaaataaaagtgtaagatactaagtgtgtagaataaaagtgcaataacaaaagacaatgactttggcacacacttcagtctttatcctctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 317399 - DNA, 6250 bp, Homo sapiens
ctgagggaaagcttcgtcggaaccctggaacgatgtctgcagagcctggagaagtctcaggatgtctcagttcacatcaccagtaattatctcaaacagatcttaaatgctgcctatcatgttgaagtcacgtttcactcagggtcgtcagttacaaggatgctatgggagcaaatcaaacagatcatccagcgcatcacatgggtgagcccacctgccatcactctggaatggaagaggaaggtggcccaggaagccattgagagcctcagcgcctccaaattggctaagagcatttgcagccaattccggactcggctcaatagttcccacgaggcttttgcagcctccttgcggcagctggaagctggccactcaggccggttagagaaaacggaagatctatggctgagggttcggaaagatcatgctccccgcctggcccgcctttctctggaaagccgttctttacaggatgtcttgcttcatcgtaaacctaaactgggacaggaactgggccggggccagtatggtgtggtatacctgtgtgacaactggggaggacacttcccttgtgccctcaaatcagttgtccctccagatgagaagcactggaatgatctggctttggaatttcactatatgaggtctctgccgaagcatgagcgattggtggatctccatggttcagtcattgactacaactatggtggtggctccagcattgctgtgctcctcattatggagcggctacaccgggatctctacacagggctgaaggctgggctgaccctggagacacgtttgcagatagcactagatgtggtggagggaatccgcttcctgcacagccagggacttgtccatcgtgatatcaaactgaaaaatgtgctgctggataagcagaaccgtgccaagatcactgacttaggattctgcaagccagaggccatgatgtcaggcagcattgtggggacaccaatccatatggcccctgaacttttcacaggggctcgcccagaacgtcttcctgtgtttgatgaggagtgctggcagttgatggaagcctgttgggatggcgaccccttgaagaggcctctcttgggcattgtccagcccatgctccagggcatcatgaatcggctctgcaagtccaattctgagcagccaaacagaggactagatgattctacttgaaagcaaagacctttctctttcactctctagttatttccttccccctcaccttttggccatggggagaatttgacatttattcactataggacacactcccaagggaactggtgcttgctgggaaacttggaaccttcccaggcagggatgactcctggacagtgaagagttgaatgactgagcatattcagcagctcactgaagcgccaagctatccctttagcaaaaaagtgtctcagatgtgtaaaagctgaggaatgtggtgttctggcttcacaaatgaaaaggaggcagatgttaccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaagaggccaggcatggtggctcacgcctgtaatctcagcactttggaaggctgaggcgggcggatcacaaggtccagagttcaagagcagcctggccaacatggtgaaaccccgtctctactaaagatacaaaaaattagccgggcgtggtggtgcatgcctgtaatccaagatactcaggaggctgaggcaggagaatcgcttgaacctgggaggcggaggttgcagtgagccgagatcatgccattgcactccagcctgggcgacagagtgagactctgtctcaaaaaaaaaaaaaaatagaatgtgtatgcatatatttgtgtgtatatgtatatatgtgtgtgtgtctatatctctatctatatagacatacacacaggagttattggatttagagttactgctaaccccagaacagaatctgttcttttacctttgagtcttttcttttgtttacctcttttcatctcaaagtgggaaagctccagataacatggtacttaggagtgagtgtctaagcaaaaccaacccaatgcgaagtatttgggtgagaactgagaggtgggagatgattggaggccatggcctatgtacaaacatactggaagaaaaccagcttgtttttaaaacttaacacaatcagaaatttttctttttgtgtttgaatctaacacactgacgtttggaaaacttgatcaatgagcttttaaccacgatttctcccgcaatttgttccttctttttacctttttaaaaatctgttagaagaaaaaaagcagcagacgaaagagaaaaaccctcctctggtagttctgtgtgtgcccctcacccctgtgtgctagtgtctgggaagtttccctgaaaggtgggaggcgggtgggtggtcttttggagggttcctcatgaagtgtgcttgaggaaagaaattctgattctaggcagaggaaggggaacaatttaaatattggtgcatctcagatgcacttgacttcaagccttcctcaaccaaactggtccattagattccgaaaaacaggtagacgaggaagtagacagtggaagtgagtagtctccctccatctgcctaatccccaataactgtggtctggcccctgtgttcagccccagagtttgtaaaacaggtccccaggtaggtgtataagatgagttgcaaattagccgggcatgctggcacgcaccagtaatcccagctacttgggaggctgaggcaggagaatcacttgaacccgggaggcagaggtcatggtgagccgagatcacgccactgcactccagccctgggcaacagagcgagactctatctcaaaaaaaaacaaaaaaaaaaaacaaaaaacaaagatgagtcgcacatctgctgctgggattttctagggttgtctatgacagaatgaccatcttttaaatattaatggagtataaatggagtctataatgggtctttcatataacttttaactctttggctatcctgggctctgatcatgatatgtttgagcatagtagctccctaaactcttggagcctttcagaaattccatgtagtgctaataacctttttacttgcaaatgataaagtaactgactcagtgtctttgggctctgcaggctttagccttgttttggtaggatgttcagtatattctcagaattttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtattttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcgactagtacctgtcagctctcaaatgcattcttgtgtctttgcttgagctgccaaagaagggtcacaaagtgttcttcctcatggaagaagtgcctcggggttgcagggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctcaaaaaaaaaaaaaagaaaaagaaaaagaaggttaatccttcagttatggaggtgggatgaatagagcttgtttgatgttaaagtgggtaaggagggagtggccttgagacacttgtattccaaactctcctggaggtttccagtagcactactgttcctaaaagggtttcatttttaacttcatctgttttgttaacatccagtccaattgaggtgatctcagaggtgcatcaggacatctagcactggggaggccaccttgcccagatagttgaaaagaaaattggtctgggcagcctgttgtcttttgtcttcatgtaatgttttttctttgttttaaaggactaatgtttattacagtgttaaataaaagtgtaagatactaagtgtgtagaataaaagtgcaataacaaaagacaatgactttggcacacacttcagtctttatcctctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 317400 - DNA, 5192 bp, Homo sapiens
aacggctaggtacgaggctgggtggtgactgaagaggcctctcttgggcattgtccagcccatgctccagggcatcatgaatcggctctgcaagtccaattctgagcagccaaacagaggactagatgattctacttgaaagcaaagacctttctctttcactctctagttatttccttccccctcaccttttggccatggggagaatttgacatttattcactataggacacactcccaagggaactggtgcttgctgggaaacttggaaccttcccaggcagggatgactcctggacagtgaagagttgaatgactgagcatattcagcagctcactgaagcgccaagctatccctttagcaaaaaagtgtctcagatgtgtaaaagctgaggaatgtggtgttctggcttcacaaatgaaaaggaggcagatgttaccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaagaggccaggcatggtggctcacgcctgtaatctcagcactttggaaggctgaggcgggcggatcacaaggtccagagttcaagagcagcctggccaacatggtgaaaccccgtctctactaaagatacaaaaaattagccgggcgtggtggtgcatgcctgtaatccaagatactcaggaggctgaggcaggagaatcgcttgaacctgggaggcggaggttgcagtgagccgagatcatgccattgcactccagcctgggcgacagagtgagactctgtctcaaaaaaaaaaaaaaatagaatgtgtatgcatatatttgtgtgtatatgtatatatgtgtgtgtgtctatatctctatctatatagacatacacacaggagttattggatttagagttactgctaaccccagaacagaatctgttcttttacctttgagtcttttcttttgtttacctcttttcatctcaaagtgggaaagctccagataacatggtacttaggagtgagtgtctaagcaaaaccaacccaatgcgaagtatttgggtgagaactgagaggtgggagatgattggaggccatggcctatgtacaaacatactggaagaaaaccagcttgtttttaaaacttaacacaatcagaaatttttctttttgtgtttgaatctaacacactgacgtttggaaaacttgatcaatgagcttttaaccacgatttctcccgcaatttgttccttctttttacctttttaaaaatctgttagaagaaaaaaagcagcagacgaaagagaaaaaccctcctctggtagttctgtgtgtgcccctcacccctgtgtgctagtgtctgggaagtttccctgaaaggtgggaggcgggtgggtggtcttttggagggttcctcatgaagtgtgcttgaggaaagaaattctgattctaggcagaggaaggggaacaatttaaatattggtgcatctcagatgcacttgacttcaagccttcctcaaccaaactggtccattagattccgaaaaacaggtagacgaggaagtagacagtggaagtgagtagtctccctccatctgcctaatccccaataactgtggtctggcccctgtgttcagccccagagtttgtaaaacaggtccccaggtaggtgtataagatgagttgcaaattagccgggcatgctggcacgcaccagtaatcccagctacttgggaggctgaggcaggagaatcacttgaacccgggaggcagaggtcatggtgagccgagatcacgccactgcactccagccctgggcaacagagcgagactctatctcaaaaaaaaacaaaaaaaaaaaacaaaaaacaaagatgagtcgcacatctgctgctgggattttctagggttgtctatgacagaatgaccatcttttaaatattaatggagtataaatggagtctataatgggtctttcatataacttttaactctttggctatcctgggctctgatcatgatatgtttgagcatagtagctccctaaactcttggagcctttcagaaattccatgtagtgctaataacctttttacttgcaaatgataaagtaactgactcagtgtctttgggctctgcaggctttagccttgttttggtaggatgttcagtatattctcagaattttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtattttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcgactagtacctgtcagctctcaaatgcattcttgtgtctttgcttgagctgccaaagaagggtcacaaagtgttcttcctcatggaagaagtgcctcggggttgcagggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctcaaaaaaaaaaaaaagaaaaagaaaaagaaggttaatccttcagttatggaggtgggatgaatagagcttgtttgatgttaaagtgggtaaggagggagtggccttgagacacttgtattccaaactctcctggaggtttccagtagcactactgttcctaaaagggtttcatttttaacttcatctgttttgttaacatccagtccaattgaggtgatctcagaggtgcatcaggacatctagcactggggaggccaccttgcccagatagttgaaaagaaaattggtctgggcagcctgttgtcttttgtcttcatgtaatgttttttctttgttttaaaggactaatgtttattacagtgttaaataaaagtgtaagatactaagtgtgtagaataaaagtgcaataacaaaagacaatgactttggcacacacttcagtctttatcctctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 317401 - DNA, 4996 bp, Homo sapiens
ttcgacggtgttctgcctccacaggtgcaggtctcccagacagacctgtacctgaatggacgaaactctctgccttcctgttgcaagtgcccctgtaagggaggacctcccacattgtactggaatcatctgtgacttgcaagagcaggaagtggagggcagcagctgcctgtgtctgcacccagaacaccgtcgagcttcgacggtgttctggcttcacaaatgaaaaggaggcagatgttaccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaagaggccaggcatggtggctcacgcctgtaatctcagcactttggaaggctgaggcgggcggatcacaaggtccagagttcaagagcagcctggccaacatggtgaaaccccgtctctactaaagatacaaaaaattagccgggcgtggtggtgcatgcctgtaatccaagatactcaggaggctgaggcaggagaatcgcttgaacctgggaggcggaggttgcagtgagccgagatcatgccattgcactccagcctgggcgacagagtgagactctgtctcaaaaaaaaaaaaaaatagaatgtgtatgcatatatttgtgtgtatatgtatatatgtgtgtgtgtctatatctctatctatatagacatacacacaggagttattggatttagagttactgctaaccccagaacagaatctgttcttttacctttgagtcttttcttttgtttacctcttttcatctcaaagtgggaaagctccagataacatggtacttaggagtgagtgtctaagcaaaaccaacccaatgcgaagtatttgggtgagaactgagaggtgggagatgattggaggccatggcctatgtacaaacatactggaagaaaaccagcttgtttttaaaacttaacacaatcagaaatttttctttttgtgtttgaatctaacacactgacgtttggaaaacttgatcaatgagcttttaaccacgatttctcccgcaatttgttccttctttttacctttttaaaaatctgttagaagaaaaaaagcagcagacgaaagagaaaaaccctcctctggtagttctgtgtgtgcccctcacccctgtgtgctagtgtctgggaagtttccctgaaaggtgggaggcgggtgggtggtcttttggagggttcctcatgaagtgtgcttgaggaaagaaattctgattctaggcagaggaaggggaacaatttaaatattggtgcatctcagatgcacttgacttcaagccttcctcaaccaaactggtccattagattccgaaaaacaggtagacgaggaagtagacagtggaagtgagtagtctccctccatctgcctaatccccaataactgtggtctggcccctgtgttcagccccagagtttgtaaaacaggtccccaggtaggtgtataagatgagttgcaaattagccgggcatgctggcacgcaccagtaatcccagctacttgggaggctgaggcaggagaatcacttgaacccgggaggcagaggtcatggtgagccgagatcacgccactgcactccagccctgggcaacagagcgagactctatctcaaaaaaaaacaaaaaaaaaaaacaaaaaacaaagatgagtcgcacatctgctgctgggattttctagggttgtctatgacagaatgaccatcttttaaatattaatggagtataaatggagtctataatgggtctttcatataacttttaactctttggctatcctgggctctgatcatgatatgtttgagcatagtagctccctaaactcttggagcctttcagaaattccatgtagtgctaataacctttttacttgcaaatgataaagtaactgactcagtgtctttgggctctgcaggctttagccttgttttggtaggatgttcagtatattctcagaattttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtattttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcgactagtacctgtcagctctcaaatgcattcttgtgtctttgcttgagctgccaaagaagggtcacaaagtgttcttcctcatggaagaagtgcctcggggttgcagggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctcaaaaaaaaaaaaaagaaaaagaaaaagaaggttaatccttcagttatggaggtgggatgaatagagcttgtttgatgttaaagtgggtaaggagggagtggccttgagacacttgtattccaaactctcctggaggtttccagtagcactactgttcctaaaagggtttcatttttaacttcatctgttttgttaacatccagtccaattgaggtgatctcagaggtgcatcaggacatctagcactggggaggccaccttgcccagatagttgaaaagaaaattggtctgggcagcctgttgtcttttgtcttcatgtaatgttttttctttgttttaaaggactaatgtttattacagtgttaaataaaagtgtaagatactaagtgtgtagaataaaagtgcaataacaaaagacaatgactttggcacacacttcagtctttatcctctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 317402 - DNA, 1221 bp, Homo sapiens
  misc_feature (11)..(11): n is a, c, g, or t
tcccgtctggnatgcaaaatgtcctctggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctcaaaaaaaaaaaaaagaaaaagaaaaagaaggttaatccttcagttatggaggtgggatgaatagagcttgtttgatgttaaagtgggtaaggagggagtggccttgagacacttgtattccaaactctcctggaggtttccagtagcactactgttcctaaaagggtttcatttttaacttcatctgttttgttaacatccagtccaattgaggtgatctcagaggtgcatcaggacatctagcactggggaggccaccttgcccagatagttgaaaagaaaattggtctgggcagcctgttgtcttttgtcttcatgtaatgttttttctttgttttaaaggactaatgtttattacagtgttaaataaaagtgtaagatactaagtgtgtagaataaaagtgcaataacaaaagacaatgactttggcacacacttcagtctttatcctctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 317403 - DNA, 1246 bp, Homo sapiens
gccatggggcagcgagcccgtctcgggtcccggccccggcggcggcggaatgatccgcgagctgtgccggggcttcggccgctaccgccgctacctgggacggctgcgacagaacctgcgcgagacccagaagttcttccgcgacatcaagtgctcccacaaccacacttgtctctcctccctcacgggcggcggcggggccgagcgcggccctgcaggcgatgtcgccgaaaccgggctgcaggcgggccaactgagctgcatttccttcccacctaaggaagagaagtacctccagcagattgtggactgcctcccttgcatactgatcctcggccaggattgtaacgtcaagtgccagctgttgaatctgctgttgggggtgcaggtgcttcccaccaccaagctgggcagtgaggagagctgtaagcttcggcgcctccgcttcacctatgggactcagactcgggtcagcctggcgctccctggacagtatgaactagtgcacacgctggttgctcatcagggcaactgggagaccatccctgaggaggatctggaggtccaagagaacaatgaggatgctgctcatgttttagcggaactggaggtaacgatgcaccatgctctcttacaggaagtggacgttgtggtagcaccatgccaaggcctccggcccacagtggatgttctgggtgacttggtgaatgatttcttgcctgtgataacctatgcactccacaaagatgaactctctgagagggatgagcaagagcttcaggaaatccgaaagtatttctcctttcctgtattctttttcaaagtgccgaaactgggctcggagataatagactcctcaaccaggagaatggagagcgaaagatcaccgctttatcgccagctaattgacctgggctatctgagcagcagtcactggaactgtggggctcctggccaggatactaaagctcagagcatgttggtggaacagagtgaaaagctgagacacttgagcacattttctcaccaggtgttacagactcgcctggtggatgcagccaaggccctgaacctggtgcactgccactgccttgacatctttattaaccaggcatttgacatgcagcgggacctgcagatcactcccaaacgtctggaatatactcgaaaaaaggagaatgagtgtatgaatcatatgatgaatattgccgaaagcaggaggaaatgaaggatatgattgtggaga

SEQ ID NO: 317404 - DNA, 1681 bp, Homo sapiens
ctgagggaaagcttcgtcggaaccctggaacgatgtctgcagagcctggagaagtctcaggatgtctcagttcacatcaccagtaattatctcaaacagatcttaaatgctgcctatcatgttgaagtcacgtttcactcagggtcgtcagttacaaggatgctatgggagcaaatcaaacagatcatccagcgcatcacatgggtgagcccacctgccatcactctggaatggaagaggaaggtggcccaggaagccattgagagcctcagcgcctccaaattggctaagagcatttgcagccaattccggactcggctcaatagttcccacgaggcttttgcagcctccttgcggcagctggaagctggccactcaggccggttagagaaaacggaagatctatggctgagggttcggaaagatcatgctccccgcctggcccgcctttctctggaaagccgttctttacaggatgtcttgcttcatcgtaaacctaaactgggacaggaactgggccggggccagtatggtgtggtatacctgtgtgacaactggggaggacacttcccttgtgccctcaaatcagttgtccctccagatgagaagcactggaatgatctggctttggaatttcactatatgaggtctctgccgaagcatgagcgattggtggatctccatggttcagtcattgactacaactatggtggtggctccagcattgctgtgctcctcattatggagcggctacaccgggatctctacacagggctgaaggctgggctgaccctggagacacgtttgcagatagcactagatgtggtggagggaatccgcttcctgcacagccagggacttgtccatcgtgatatcaaactgaaaaatgtgctgctggataagcagaaccgtgccaagatcactgacttaggattctgcaagccagaggccatgatgtcaggcagcattgtggggacaccaatccatatggcccctgaacttttcacaggggctcgcccagaacgtcttcctgtgtttgatgaggagtgctggcagttgatggaagcctgttgggatggcgaccccttgaagaggcctctcttgggcattgtccagcccatgctccagggcatcatgaatcggctctgcaagtccaattctgagcagccaaacagaggactagatgattctacttgaaagcaaagacctttctctttcactctctagttatttccttccccctcaccttttggccatggggagaatttgacatttattcactataggacacactcccaagggaactggtgcttgctgggaaacttggaaccttcccaggcagggatgactcctggacagtgaagagttgaatgactgagcatattcagcagctcactgaagcgccaagctatccctttagcctgctgtgtcactgctatgtgcttccaaccgcgccggggagtcccactggtctagaaaccggtctgaggcaccggctagttcccgacttgtttctcagtggtgaacacttctgggcctggtctggagtggcacaggtctcaaaagtggaacgtggaatggggggaaaaaaagcgtttgcccaaaaaaagaaaaaacacacaacaaaaagaaaaaaaagggggggaatacaagggggccacccttaagccaagaaaaaggg

SEQ ID NO: 317405 - DNA, 830 bp, Homo sapiens
ctgagggaaagcttcgtcggaaccctggaacgatgtctgcagagcctggagaagtctcaggatgtctcagttcacatcaccagtaattatctcaaacagatcttaaatgctgcctatcatgttgaagtcacgtttcactcagggtcgtcagttacaaggatgctatgggagcaaatcaaacagatcatccagcgcatcacatgggtgagcccacctgccatcactctggaatggaagaggaaggtggcccaggaagccattgagagcctcagcgcctccaaattggctaagagcatttgcagccaattccggactcggctcaatagttcccacgaggcttttgcagcctccttgcggcagctggaagctggccactcaggccggttagagaaaacggaagatctatggctgagggttcggaaagatcatgctccccgcctggcccgcctttctctggaaagccgttctttacaggatgtcttgcttcatcgtaaacctaaactgggacaggaactgggccggggccagtatggtgtggtatacctgtgtgacaactggggaggacacttcccttgtgccctcaaatcagttgtccctccagatgagaagcactggaatgatctggctttggaatttcactatatgaggtctctgccgaagcatgagcgattggtggatctccatggttcagtcattgactacaactatggtggtggctccagcattgctgtgctcctcattatggagcggctacaccgggatctctacacagggctgaaggctgggctgaccctggaggtcgacgcggccgcgaatttagtagtagtaga

SEQ ID NO: 317406 - DNA, 386 bp, Homo sapiens
gctgcggtgatctagaggatcccagttcgacggagactctcatgtaatgttttttctttgttttaaaggactaatgtttattacagtgttaaataaaagtgtaagatactaagtgtgtagaataaaagtgcaataacaaaagacaatgactttggcacacacttcagtctttatcctctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 317407 - DNA, 347 bp, Homo sapiens
actgaggcaaggtggtgtagatgctgctgcctgactctctgtggctcattacgtttcatcctttcttgccatcagggaagtacgataattccgtggatgtctacgcttttggaattcttttctggtatatctgctcaggctctgtcaagctccctgaggcatttgagaggtgtgctagcaaagaccatctctggaacaatgtgcggaggggtaagagccacaagtactaccttgtcctaactcccctggctagcgcagactgagcccaggcaatgtcaccgggtctcctgtcatcccatctggccactccatagcagggccgtagatacgtttaaactgtcatgaat

SEQ ID NO: 317408 - DNA, 372 bp, Homo sapiens
ccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaa

SEQ ID NO: 317409 - DNA, 2684 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317410 - DNA, 2909 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccggcccccctgtcccgggagacgccccccagccacagcccacctgctgagggggacccccgcacccaccaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317411 - DNA, 2537 bp, Homo sapiens
gaattccgggggttccggcgctccgcggccccaagcgccctcctttcctccctccgccggccggggttgcgggcgcggggcgccgcgggccatgcgatctcggcgcggcccagcccggccggcggcgccccgcccccgctggagcctggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggaggcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317412 - DNA, 3360 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccagggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgaggtaggaagcccgcctcctcctgtcttggttttcatgattttgatcctcatggtagctgtctgagtcagtctctcagaccccctttttctctctcttctttttgcctttttgctccattttctcatcccttcttcaaggcctcatcatgtcactcccatttcctacagatcaaagatccccaaggctctgattcctttaatctcttgctcccccctccccagcccaccaagctttaactctcctgtgacaccccccacgcccctcccccctcctcagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317413 - DNA, 3309 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccagggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccggcccccctgtcccgggagacgccccccagccacagcccacctgctgagggggacccccgcacccaccaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317414 - DNA, 1833 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317415 - DNA, 3118 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagagatgatctgccagagaggttgaacctcctggtaatgtgtggggaaagcgggagtggaacttggctgctctggggaaggagtagtcaagaaagccagttccaggggtcacaaggcaaggtttccgctgcgcagccacaaggtcttgtctccagctcctggggcaggtggagtacacgggccgggctttaccagcacgcacccattcagatcgcgctgtgatccgtggtgtttctcctgtgcaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317416 - DNA, 2715 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggatctgggagacagacacagacacaaacgcaga

SEQ ID NO: 317417 - DNA, 2834 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccagttttcgcagtataaattttaaagtataaaaaaaaacaacacacaagaaaaacaaccacccggaggaccacacataatggcaggggtcagcggaaaaaaagggggtaatgctgagtgggcagccggtggccaataagctgatacccgtgaccaagcattactggtacaagggtgtgaaatagaggggtccc

SEQ ID NO: 317418 - DNA, 2726 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggaaaaaaaaaaaatacttaacaaaaaaaaaagtcgtatcgatgt

SEQ ID NO: 317419 - DNA, 2884 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggaaaaaaaaaaagaaaaaaaaaaaaaaaaaaaaaaaaaaaaaaaaaaaaaaaacaaaaaaaaaaaaaaaaaaaaaaaaaaaaaaaaaaattcaattgactgcccgtcctcatccaagggactgactgaaccttgcctgaactcacccaacttaatcggcttgaagtacatcctactttagctagctgtcgtaagagcgagca

SEQ ID NO: 317420 - DNA, 1655 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317421 - DNA, 1476 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317422 - DNA, 2118 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccggcccccctgtcccgggagacgccccccagccacagcccacctgctgagggggacccccgcacccaccaggtactggtgaggtttgtccaatggcggcggcagcggcagcggcggcagcggcagcagcggcagcagtagcagcccctcccacagctgtgggctccctctcgggggcggagggggtgcctgtgagctctcagccacttcctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317423 - DNA, 1893 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttcctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317424 - DNA, 321 bp, Homo sapiens
aggtttgagggggaatgctggagattgtaatgggtatggagacatatcatataagtaatgctagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317425 - DNA, 335 bp, Homo sapiens
tgggcgcgtgggttgtgcgcgtgggttgtgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggcttcaccacggcagcatacctgcgcatccacgcggtgaaggaccacgggctccaggccccgcgggctgaccgcatcctgtgcaagctgtgcagcgtgcactgcaagacccctgcccagctggccggcccacaaccacgacgggggatcctgctagagatcgaccagcaag

SEQ ID NO: 317426 - DNA, 3084 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccagggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317427 - DNA, 2741 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317428 - DNA, 2823 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgaggcctcatcatgtcactcccatttcctacagatcaaagatccccaaggctctgattcctttaatctcttgctcccccctccccagcccaccaagctttaactctcctgtgacaccccccacgcccctcccccctcctcagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317429 - DNA, 3707 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagagatgatctgccagagaggttgaacctcctggtaatgtgtggggaaagcgggagtggaacttggctgctctggggaaggagtagtcaagaaagccagttccaggggtcacaaggcaaggtttccgctgcgcagccacaaggtcttgtctccagctcctggggcaggtggagtacacgggccgggctttaccagcacgcaccctgcacgggtagcagagaaagctgccttcagtcagactcaccggttaactgggttgagaccgcggggcactggagggaaggggacacagccgtctctgctgagggtcaaccctgcaagtggctaggagtcagtgtctcgtcatcctgggagaggtctcccggccatggagaatgagttctgtaggtaccaaggctgagaagcgggcaccacacaagccaggccccaggctcagggaggggctgtgtctaccagccccaacagagcagttggccccaggctaccaaggataccgtgggaggaggacagggccatctgaggagggcatcccccgcctaggagatcagccccgtctctggggtctccgcctggctgacccccgccccatcccaatccaccccccaataggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccggcccccctgtcccgggagacgccccccagccacagcccacctgctgagggggacccccgcacccaccaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317430 - DNA, 2862 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggaaaaaaaaaaaaaaaaaaaaaaaaaaaaaacaaaaaaaaaaaaaaaaaaaaaaaaaaaaaaaaaaattcaattgactgcccgtcctcatccaagggactgactgaaccttgcctgaactcacccaacttaatcggcttgaagtacatcctactttagctagctgtcgtaagagcgagca

SEQ ID NO: 317431 - DNA, 4107 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccagggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagagatgatctgccagagaggttgaacctcctggtaatgtgtggggaaagcgggagtggaacttggctgctctggggaaggagtagtcaagaaagccagttccaggggtcacaaggcaaggtttccgctgcgcagccacaaggtcttgtctccagctcctggggcaggtggagtacacgggccgggctttaccagcacgcaccctgcacgggtagcagagaaagctgccttcagtcagactcaccggttaactgggttgagaccgcggggcactggagggaaggggacacagccgtctctgctgagggtcaaccctgcaagtggctaggagtcagtgtctcgtcatcctgggagaggtctcccggccatggagaatgagttctgtaggtaccaaggctgagaagcgggcaccacacaagccaggccccaggctcagggaggggctgtgtctaccagccccaacagagcagttggccccaggctaccaaggataccgtgggaggaggacagggccatctgaggagggcatcccccgcctaggagatcagccccgtctctggggtctccgcctggctgacccccgccccatcccaatccaccccccaataggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccggcccccctgtcccgggagacgccccccagccacagcccacctgctgagggggacccccgcacccaccaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317432 - DNA, 2840 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggaaaaaaaacaaaaaaaaaaaaaaaaaaaaaaaaaaaaaaaaaaattcaattgactgcccgtcctcatccaagggactgactgaaccttgcctgaactcacccaacttaatcggcttgaagtacatcctactttagctagctgtcgtaagagcgagca

SEQ ID NO: 317433 - DNA, 2665 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccattacaataaattttaaataaaatcctgtttctggctctgga

SEQ ID NO: 317434 - DNA, 2557 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttcctccagaaggaaaggaggaagaaatgttttcttaggggaattcgctaggttttaacgatttgtttctcctgctcctcttctatcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317435 - DNA, 2414 bp, Homo sapiens
  misc_feature (30)..(30): n is a, c, g, or t
  misc_feature (36)..(36): n is a, c, g, or t
  misc_feature (103)..(103): n is a, c, g, or t
  misc_feature (117)..(117): n is a, c, g, or t
ccgccgccgccgccgccgccgcccggcgcnaccgcncccggccccggccccgcggggcctcccgcccccacccagggggcgtcgccgccgccgtcgccgcggnctccgcggcccgcnaggcgcccgaattccggctccctcccgccggccggggtgcgcgggccggcggggccggcccgggcgggccatgcgttcggcgcggcccagcccggccggccgggggcggcgccccgagcccgggccccgcgcggcccgcgcccccggcccccgctgagccctgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctatcagacctgaccccacacaaacgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctgga

SEQ ID NO: 317436 - DNA, 1713 bp, Homo sapiens
cggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgatgccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcagtcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgtatctttttagattgtatgaactgtatctttttagattctctaatagacaatataatttcaatgaaaatggtggacgagtgaaaatgaagtggaagaaactaactagattttcgagttttatggctcatgtaacatctatacttggctgatgaagacgactggctgtgacttaccgccaacaatagaatgaaagaagatggtgttaaaagtataagataccacctcatacccattagaatgactcccatcaaaacatacaaacaaacacaaaataacaggtgtttgcagggatgtagaataatcggaaccctgtg

SEQ ID NO: 317437 - DNA, 460 bp, Homo sapiens
ttccagtgctgtacaaagagacagaggctgttagctatggctgaagacaaccacaaaaaaaaaacagttaagatgttggaatacctgggcaaagatgttcttcatggtgtttttaattatttggcaaaacacgatgttctgacattgaaggaagaggaaaagaaaaaatattatgatgccaaaattgaagacaaggccctgatcttggtagactctttgcgaaagaatcgcgtggctcatcaaatgtttacccaaacacttctcaatatggaccaaaagatcaccagtgtaaaacaataaacgtgctccacttttaacccttttccgcttcagtaaaaagaagtaacatgcaccaagtttctgctaccagaatgtaactggtttcttcaccaattaataagagtaattaatggagatcctggcacatagcagatacctaattaatgtgtgatgaataaac

SEQ ID NO: 317438 - DNA, 209 bp, Homo sapiens
ctttatgacaccatcttccagatattcaacaaccgcaactgcctcagtctaaaggacaaacccaaggtcatcattgtccaggcctgcagaggtggtgagtgctgaggctgaacatctaacagttttgaaggtgtatgcagaggattgtgatgtttggtttatatttaggggaaacaatgttagaccccatccagtgcaaataaagtaca

SEQ ID NO: 317439 - DNA, 445 bp, Homo sapiens
cattctccctagtcatcagtcttaccacctgtgaaatgtgggcaattccagcactttctcacaagactgtctacagccagaaacattgtaatgccaggcaccacatgccaacaacttccaagataccagctctcattcaggactctctcatctgagctccagactcatttagctctagcggcatataaaacaattctgctccagtgtttcactggcatcacaaaatgaatacagctaaaattaaatgctttgttttccagaataaacgtgctccacttttaacccttttccgcttcagtaaaaagaagtaacatgcaccaagtttctgctaccagaatgtaactggtttcttcaccaattaataagagtaattaatggagatcctggcacatagcagatacctaattaatgtgtgatgaataaacaaatgaagtatacgcatgca

SEQ ID NO: 317440 - DNA, 1654 bp, Homo sapiens
ttccagtgctgtacaaagagacagaggctgttagctatggctgaagacaaccacaaaaaaaaaacagttaagatgttggaatacctgggcaaagatgttcttcatggtgtttttaattatttggcaaaacacgatgttctgacattgaaggaagaggaaaagaaaaaatattatgatgccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcagtcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatttcagctaaagatggggtccttgtcacacgaccatgagaaattagactcacagacaatctgaaaggaaaccacaggcagcccagccctcctctgtcaacatcaaagagcacatttaccagtatagcttgcatagtcaatatttggtatttcaataaaagtaaagactgtatctttttagattgtatgaactgtatctttttagattctctaatagacaatataatttcaatgaaaatggtggacgagtgaaaatgaagtggaagaaactaactagattttcgagttttatggctcatgtaacatctatacttggctgatgaagacgactggctgtgacttaccgccaacaatagaatgaaagaagatggtgttaaaagtataagataccacctcatacccattagaatgactcccatcaaaacatacaaacaaacacaaaataacaggtgtttgcagggatgtagaataatcggaaccctgtg

SEQ ID NO: 317441 - DNA, 477 bp, Homo sapiens
gcaagagcacaaggaaacaagcagaaggaattcagagaaacagctccaggctccagctcaaaggccgacaccaaaagcgaacacctctgggcgctcttgccttcaagaaggtggggaggctcacagacgcagcatccacccctcgcagggaacctcagttcctggcctgtggtcccatgaaggacatcaggctggcagattggagcacaccccttctttctaacccctcttgaaagcttccttgaatctgccagtcctgccccctggagcaggaaggaaaacagaaggcctaggacgctagaggggtcccgagctttccggagctccagccaccatcaggtctgactgctcagggacagacacaccgaccacatcctgacctcaggatgacctgcggaagtacttggcatttcttcttagccaaatcccttcattaaaagacgggtgagggttccagcgctgccctcttccttctca

SEQ ID NO: 317442 - DNA, 838 bp, Homo sapiens
cgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagtctggaatctctggagaagccagaagcatatgtctcagaatattaacctcatcagatcctcagagcaaagagggttttatatgaaataagtttgagaaatgctgtttacttgaccctgtatttggagagtcccagtgtccattaggatattaaagtgatgatggatcctgctgtc

SEQ ID NO: 317443 - DNA, 554 bp, Homo sapiens
ggggcgcaacaaaatgctttctagagatcagatctagagatcagatttcagcatgggatgacagcaggcaggaccagcctcacgggcctgcaggcagttgcctggggcctcatgcctgaccagcctcatgggcctgtaggcagttgcctggggcctcatgcctagaagggtgccatgcttggtttaatgttctcctgttgctgtctagaaattgttaatacgtttggaacatggggccctacattttcatattggattgaactctgcaaactacgtacctggtcctggtagttgttcctccctaattgcaaagtttggtgcatttcatagaaagaattgggtagctactgaggctcagggagctctggcctctcttaggtctggaatctctggagaagccagaagcatatgtctcagaatattaacctcatcagatcctcagagcaaagagggttttatatgaaataagtttgagaaatgctgtttacttgaccctgtatttggagagtcccagtgtccattaggatattaaagtgatgatggatcctgctgtc

SEQ ID NO: 317444 - DNA, 502 bp, Homo sapiens
ccagactccgtctaaaaacaaaacaaaacaaagcaaacgaagtaaattactttggaaaacacattttctggttcccaaagggtgtgctcacgaatacacatttgcggcacaggctgaagtctgtcctcaaggtgtatgatggtcgcagagcaaggctgtgccctggaaccatgtcagggtctgtcccatggtgcagccttggggtcctgatggttgtatttcctgtctcctgcacagatcagctggacatcatctccatggcggagacaaccatgatgccagaggagattgagctggagatggcaaaaattcagcgtctccgggaagtcttggtccgccgggagtctgagctcaggttcatgtgagtgttttggggatgtggccaaggaaagaagtgtgtggaggagagaggaaaacctaatatttgttgatcgtctactgtgtgccaggcactgagataaaggcattatgcacgtttttaaaagcctcatttgattctcac

SEQ ID NO: 317445 - DNA, 2423 bp, Homo sapiens
cgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317446 - DNA, 2340 bp, Homo sapiens
cgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317447 - DNA, 2328 bp, Homo sapiens
ggctggggaaacagaaactcgcagaagttaaaaaaatgtgcttgaggtgccactggagaataacaatcatagccaggatctgaagcctgtcagtttcctcagccgcaaattcttccatgtggggcgacctcacagagacgggatgtatgggacggcggagtgcaaagaaagatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317448 - DNA, 2299 bp, Homo sapiens
cgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaagatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317449 - DNA, 1928 bp, Homo sapiens
cgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgctgtgcaatcttgcacaaatatcttaccttctctgagcctcggtggcctcatctgttaaatagccatgcatccagtatctcgcagggtggtcatgaggagtaaaagagatcaagcgtattaagtgctcagtccagtgcctgctaccacgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccacacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317450 - DNA, 1615 bp, Homo sapiens
ccagactccgtctaaaaacaaaacaaaacaaagcaaacgaagtaaattactttggaaaacacattttctggttcccaaagggtgtgctcacgaatacacatttgcggcacaggctgaagtctgtcctcaaggtgtatgatggtcgcagagcaaggctgtgccctggaaccatgtcagggtctgtcccatggtgcagccttggggtcctgatggttgtatttcctgtctcctgcacagatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccatctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317451 - DNA, 714 bp, Homo sapiens
  misc_feature (61)..(61): n is a, c, g, or t
tacctagctgcactgtcatatgttattatcccaaatcttgtcaaatgcatcagtaagcagnacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317452 - DNA, 864 bp, Homo sapiens
tttcgtttctggtcctttttcctcagagatcacttcaataaaaaaatgtatgaggaatttagacaacttgcttgggaagatgcaaaagaaaattacaggtcagatattttcttttacacttcaagggagttttattattttcttcttctttttttctttacccaggtagatccgatagagggagtttttagaaaataatttttaaaactagtactgaagtagcctgattttgaaccgtgaaagtagcacaatataactagagggagacctgtattagttttctatttctgcattgcaaattaccccaaaactccataggttaaaacaataaacatttgttagttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317453 - DNA, 176 bp, Homo sapiens
gggaaaacctctacaatgagcatgtatggcctcttcaaaagataacccacctttaatagcttctttgtgttaaccgggtgatgctcagggcgtaatgctctgctgatgtaacctgctgttgatggtgtcctgtttccccaggatggatgacatccagctctgcaaggacatcatgg

SEQ ID NO: 317454 - DNA, 488 bp, Homo sapiens
tgatttttttaaaaaaagaaaacattaaaaaatccaatttatttaagctgtcacagacgcttccagattaccagggccaccttccaagctgggaaaccttgcagactgtggggtcctgcacacctagacttgctccttttagaagccatggaggaggttgataatgggaataacatttattgtagcttatctctatgccttgagcaatgtgctcacactggctggttccctcctcacatcagcctgatgagtcagatcctgttattacttctcactttacagatgaggaagtagcagtaaatccattacccttttcaagcggaggttgcaagaggttgcaagcggaggcagaataaacacttgaaacagtgagtcagatcctgttatcacttctcactttacagatgaggaagtggcagtaaatccactgcccacggtcccaggggttgttagtgacagagtcatcattcatctccctccctccccac

SEQ ID NO: 317455 - DNA, 352 bp, Homo sapiens
agagagaggatgagctaatccagaagatccacaaactggtgcagaagagagacttcctggtggacgatgcggaggtcgagcggttaaggtgagtgcactgcgggtacccgatcactgggctgcaggacagcaaccttctgcttccttccagaacccatcttctgctcctgggactcacagccttgcctaacaggcatggccttgatccacagtctctggacactgaatcccaaggaaccccagccttctggcttgagaattcattttgtatataagagaatttcaaatctgtgcctcttgagggaatgttgttccaggaagtgaccagggaggagtcacatcccataataca

SEQ ID NO: 317456 - DNA, 533 bp, Homo sapiens
ggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtt

SEQ ID NO: 317457 - DNA, 751 bp, Homo sapiens
cgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccaatgaggaagtagcagtaaatccattacccttttcaagcggaggttgcaagaggttgcaagcggaggcagaataaacacttgaaacagtg

SEQ ID NO: 317458 - DNA, 981 bp, Homo sapiens
  misc_feature (854)..(854): n is a, c, g, or t
  misc_feature (859)..(859): n is a, c, g, or t
  misc_feature (863)..(863): n is a, c, g, or t
  misc_feature (867)..(868): n is a, c, g, or t
  misc_feature (876)..(876): n is a, c, g, or t
cgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgctgtgcaatcttgcacaaatatcttaccttctctgagcctcggtggcctcatctgttaaatagccatgcatccagtatctcgcagggtggtcatgaggagtaaaagagatcaagcgtattaagtgctcagtccagtgcctgctaccacgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccactccgggcagagaagaagcagagcccactagcagccacggggncagangggncggnntgacaggntgtggggccccggacgcctggtgcccacgggggcggcggggaccccccctggttatcctcccggcacagcccggaagggtagaccctgcaccgccgggcggccag

SEQ ID NO: 317459 - DNA, 2380 bp, Homo sapiens
cgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317460 - DNA, 2572 bp, Homo sapiens
cgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgctgtgcaatcttgcacaaatatcttaccttctctgagcctcggtggcctcatctgttaaatagccatgcatccagtatctcgcagggtggtcatgaggagtaaaagagatcaagcgtattaagtgctcagtccagtgcctgctaccacgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317461 - DNA, 2394 bp, Homo sapiens
ccagactccgtctaaaaacaaaacaaaacaaagcaaacgaagtaaattactttggaaaacacattttctggttcccaaagggtgtgctcacgaatacacatttgcggcacaggctgaagtctgtcctcaaggtgtatgatggtcgcagagcaaggctgtgccctggaaccatgtcagggtctgtcccatggtgcagccttggggtcctgatggttgtatttcctgtctcctgcacagatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317462 - DNA, 1357 bp, Homo sapiens
gagggaggactctcctggtgtttgggtaaacagtgagacagatcctgggttgggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317463 - DNA, 1566 bp, Homo sapiens
cgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccacacccatatagcagtcccagagggcccatctgtaaagatcgagcttgtgtgtggtgtcgtggtcacatctcccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtgatatcatttataaccagttttttcctacttattataccaccatcttccacatcattaaaagctctttgtaaacattaaacactcttcataaatcaaaaaaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctaatttttgtatttttagtagagatggggtttcaccatattggccaggctggtctcaaactcctgac

SEQ ID NO: 317464 - DNA, 8584 bp, Homo sapiens
gcatatacaagctgagtttcagccatggaaaaactccatgggcatgtgtctgcccatccagacatcctctccttggagaaccggtgcctggctatgctccctgacttacagcccttggagaaactacatcagcatgtatctacccactcagatatcctctccttgaagaaccagtgcctagccacgcttcctgacctgaagaccatggaaaaaccacatggatatgtgtctgcccacccagacatcctctccttggagaaccagtgcctggccacactttctgacctgaagaccatggagaaaccacatggacatgtttctgcccacccagacatcctctccttggagaaccggtgcctggccaccctccctagtctaaagagcactgtgtctgccagccccttgttccagagtctacagatatctcacatgacgcaagctgatttgtaccgtgtgaacaacagcaattgcctgctctctgagcctccaagttggagggctcagcatttctctaagggactagacctttcaacctgccctatagccctgaaatccatctctgccacagagacagctcaggaagcaactttgggtcgttggtttgattcagaagagaagaaaggggcagagacccaaatgccttcttatagtctgagcttgggagaggaggaggaggtggaggatctggccgtgaagctcacctctggagactctgaatctcatccagagcctactgaccatgtccttcaggaaaagaagatggctctactgagcttgctgtgctctactctggtctcagaagtaaacatgaacaatacatctgaccccaccctggctgccatttttgaaatctgtcgtgaacttgccctcctggagcctgagtttatcctcaaggcatctttgtatgccaggcagcagctgaacgtccggaatgtggccaataacatcttggccattgctgctttcttgccggcgtgtcgcccccacctgcgacgatatttctgtgccattgtccagctgccttctgactggatccaggtggctgagctttaccagagcctggctgagggagataagaataagctggtgcccctgcccgcctgtctccgtactgccatgacggacaaatttgcccagtttgacgagtaccagctggctaagtacaaccctcggaagcaccgggccaagagacacccccgccggccaccccgctctccagggatggagcctccattttctcacagatgttttccaaggtacatagggtttctcagagaagagcagagaaagtttgagaaggccggtgatacagtgtcagagaaaaagaatcctccaaggttcaccctgaagaagctggttcagcgactgcacatccacaagcctgcccagcacgttcaagccctgctgggttacagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattgaaaatgggaagcttcccttcatggccatgcttcggaacctgtgcaacctgctgcgggttggaatcagttcccgccaccatgagctcattctccagagactccagcatgggaagtcggtgatccacagtcggcagtttccattcagatttcttaacgcccatgatgccattgatgccctcgaggctcaactcagaaatcaagcattgccctttccttcgaatataacactgatgaggcggatactaactagaaatgaaaagaaccgtcccaggcggaggtttctttgccacctaagccgtcagcagcttcgtatggcaatgaggatacctgtgttgtatgagcagctcaagagggagaagctgagagtacacaaggccagacagtggaaatatgatggtgagatgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcacggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcatgtcggatctcagaactgaagagctacctaagcagacagaaagggataacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgccttcttcaggacacagtgcaacagctgatgctgccccacggaaggctgagcctggtgacggggcagtcaggacagggcaagacagccttcctggcatctcttgtgtcagccctgcaggctcctgatggggccaaggtggcaccattagtcttcttccacttttctggggctcgtcctgaccagggtcttgccctcactctgctcagacgcctctgtacctatctgcgtggccaactaaaagagccaggtgccctccccagcacctaccgaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccggtgtgtacacctggtgctgagtgtgtctagtgatgcaggcctaggggagacccttgagcagagccagggtgcccacgtgctggccttggggcctctggaggcctctgctcgggcccggctggtgagagaggagctggccctgtacgggaagcggctggaggagtcaccatttaacaaccagatgcgactgctgctggtgaagcgggaatcaggccggccgctctacctgcgcttggtcaccgatcacctgaggctcttcacgctgtatgagcaggtgtctgagagactccggaccctgcctgccactgtccccctgctgctgcagcacatcctgagcacactggagaaggagcacgggcctgatgtccttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagtttgctaggggagggccctctggagcgccctggtgcccggctgtgcctccctgatgggcccctgagaacagcagctaaacgttgctatgggaagaggccagggctagaggacacggcacacatcctcattgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgagtcctcatttttgtgtgccagctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatctaaagacacggcagcgtagaaagattcactcgggctctgtcacagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatgaagatgtgccactcgggaataatgataccccttgtgctagagatgcaaagcctgaagacactggtagcttttaataattataaaattaataatttcttgataattataaaaatgaagtgtcaaaaaatctcaagtgtaggcctgcctgtgttctcatgtggatttagaacaggaggatattctatgtgtatgtatatgtacattctaatgtgtgtctcttcttattcaacattaatccttactagaaccacaagaaagtgaatgaaatctttagtaggtactcttttgaaactaggttttagaattcttgcatcactcgcgggccctaggaccctaggatgccattcttgccaggaggaggaatgagagtgatgttggccaacattcaatttgaacagagcatggaagacctttcagttcatcgggaaagaatgagggagggagaataagtcagtcatgcatcagggcatttagaaagagctatgtttctgtcacagagacagcccttttctcagaactacccagaggaggccgggcatggtggctcacgcttgtaatcccagcactttgggaggccgaggtgggcagatcacgaggtcaggagatcaagaccatcctggctaacatagtgaaaccctgtctctactaaaaaatacaaaaagttaaccaggcatgta

SEQ ID NO: 317465 - DNA, 713 bp, Homo sapiens
tagttctcaaacccagcaacatgactttagacagacatgccctgtagacatgactgcctttccaattgctgcctttccttttctgactcacctgtaaacatgactcacctttccttttctgagttatttttaggcatatttgggcagacatgccctgtaaacatgactcacctttccttttctgagttattttcttgctgactctgaaatgatagacctctttcttacctatcctcagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattggtagagtgaccttgaccatcacattccctccttctcttccccatttatgcctccacattttagatcctcactagaagatttctgtggaatgatgaagttattactttgcctggttgttgtatttgatttataaggtctgccattgactacaccaaagtaaacagtggtacctgctttgagtaatgttggcatcatagatcattataccagatgtagttgggtgatgtacaagtttttatcaacatatgacaaaagtaccttctctctcattgtactcatatcgatatctctgtaactcattccaaaaaaggtaggac

SEQ ID NO: 317466 - DNA, 284 bp, Homo sapiens
ggcagccctcctggaccccaccctgagtcctgagtcttgccagatgcgactgctgctggtgaagcgggaatcaggccggccgctctacctgcgcttggtcaccgatcacctgaggctcttcacgctgtatgagcaggtgtctgagagactccggaccctgcccccaccacacccagtctctccttgaactgcctgctgagaccccaagggaaccaatgtaatccgaaccctggccctcagcctcccaaccatgatccccaagcactgaccactccgtgtgactt

SEQ ID NO: 317467 - DNA, 7341 bp, Homo sapiens
tagttctcaaacccagcaacatgactttagacagacatgccctgtagacatgactgcctttccaattgctgcctttccttttctgactcacctgtaaacatgactcacctttccttttctgagttatttttaggcatatttgggcagacatgccctgtaaacatgactcacctttccttttctgagttattttcttgctgactctgaaatgatagacctctttcttacctatcctcagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattgaaaatgggaagcttcccttcatggccatgcttcggaacctgtgcaacctgctgcgggttggaatcagttcccgccaccatgagctcattctccagagactccagcatgggaagtcggtgatccacagtcggcagtttccattcagatttcttaacgcccatgatgccattgatgccctcgaggctcaactcagaaatcaagcattgccctttccttcgaatataacactgatgaggcggatactaactagaaatgaaaagaaccgtcccaggcggaggtttctttgccacctaagccgtcagcagcttcgtatggcaatgaggatacctgtgttgtatgagcagctcaagagggagaagctgagagtacacaaggccagacagtggaaatatgatggtgagatgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcacggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcatgtcggatctcagaactgaagagctacctaagcagacagaaagggataacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgccttcttcaggacacagtgcaacagctgatgctgccccacggaaggctgagcctggtgacggggcagtcaggacagggcaagacagccttcctggcatctcttgtgtcagccctgcaggctcctgatggggccaaggtggcaccattagtcttcttccacttttctggggctcgtcctgaccagggtcttgccctcactctgctcagacgcctctgtacctatctgcgtggccaactaaaagagccaggtgccctccccagcacctaccgaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccggtgtgtacacctggtgctgagtgtgtctagtgatgcaggcctaggggagacccttgagcagagccagggtgcccacgtgctggccttggggcctctggaggcctctgctcgggcccggctggtgagagaggagctggccctgtacgggaagcggctggaggagtcaccatttaacaaccagatgcgactgctgctggtgaagcgggaatcaggccggccgctctacctgcgcttggtcaccgatcacctgaggctcttcacgctgtatgagcaggtgtctgagagactccggaccctgcctgccactgtccccctgctgctgcagcacatcctgagcacactggagaaggagcacgggcctgatgtccttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagtttgctaggggagggccctctggagcgccctggtgcccggctgtgcctccctgatgggcccctgagaacagcagctaaacgttgctatgggaagaggccagggctagaggacacggcacacatcctcattgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgagtcctcatttttgtgtgccagctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatctaaagacacggcagcgtagaaagattcactcgggctctgtcacagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatgaagatgtgccactcgggaataatgataccccttgtgctagagatgcaaagcctgaagacactggtagcttttaataattataaaattaataatttcttgataattataaaaatgaagtgtcaaaaaatctcaagtgtaggcctgcctgtgttctcatgtggatttagaacaggaggatattctatgtgtatgtatatgtacattctaatgtgtgtctcttcttattcaacattaatccttactagaaccacaagaaagtgaatgaaatctttagtaggtactcttttgaaactaggttttagaattcttgcatcactcgcgggccctaggaccctaggatgccattcttgccaggaggaggaatgagagtgatgttggccaacattcaatttgaacagagcatggaagacctttcagttcatcgggaaagaatgagggagggagaataagtcagtcatgcatcagggcatttagaaagagctatgtttctgtcacagagacagcccttttctcagaactacccagaggaggccgggcatggtggctcacgcttgtaatcccagcactttgggaggccgaggtgggcagatcacgaggtcaggagatcaagaccatcctggctaacatagtgaaaccctgtctctactaaaaaatacaaaaagttaaccaggcatgta

SEQ ID NO: 317468 - DNA, 7316 bp, Homo sapiens
tagttctcaaacccagcaacatgactttagacagacatgccctgtagacatgactgcctttccaattgctgcctttccttttctgactcacctgtaaacatgactcacctttccttttctgagttatttttaggcatatttgggcagacatgccctgtaaacatgactcacctttccttttctgagttattttcttgctgactctgaaatgatagacctctttcttacctatcctcagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattgaaaatgggaagcttcccttcatggccatgcttcggaacctgtgcaacctgctgcgggttggaatcagttcccgccaccatgagctcattctccagagactccagcatgggaagtcggtgatccacagtcggcagtttccattcagatttcttaacgcccatgatgccattgatgccctcgaggctcaactcagaaatcaagcattgccctttccttcgaatataacactgatgaggcggatactaactagaaatgaaaagaaccgtcccaggcggaggtttctttgccacctaagccgtcagcagcttcgtatggcaatgaggatacctgtgttgtatgagcagctcaagagggagaagctgagagtacacaaggccagacagtggaaatatgatggtgagatgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcacggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcatgtcggatctcagaactgaagagctacctaagcagacagaaagggataacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgccttcttcaggacacagtgcaacagctgatgctgccccacggaaggctgagcctggtgacggggcagtcaggacagggcaagacagccttcctggcatctcttgtgtcagccctgcaggctcctgatggggccaaggtggcaccattagtcttcttccacttttctggggctcgtcctgaccagggtcttgccctcactctgctcagacgcctctgtacctatctgcgtggccaactaaaagagccaggtgccctccccagcacctaccgaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccggtgtgtacacctggtgctgagtgtgtctagtgatgcaggcctaggggagacccttgagcagagccagggtgcccacgtgctggccttggggcctctggaggcctctgctcgggcccggctggtgagagaggagctggccctgtacgggaagcggctggaggagtcaccatttaacaaccagatgcgactgctgctggtgaagcgggaatcaggccggccgctctacctgcgcttggtcaccgatcacctgaggctcttcacgctgtatgagcaggtgtctgagagactccggaccctgcctgccactgtccccctgctgctgcagcacatcctgagcacactggagaaggagcacgggcctgatgtccttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagtttgctaggggagggccctctggagcgccctggtgcccggctgtgcctccctgatgggcccctgagaacagcagctaaacgttgctatgggaagaggccagggctagaggacacggcacacatcctcattgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgagtcctcatttttgtgtgccagctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatctaaagacacggcagcgtagaaagattcactcgggctctgtcacagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatgaagatgtgccactcgggaataatgataccccttgtgctagagatgcaaagcctgaagacactggtagcttttaataattataaaattaataatttcttgataattataaaaatgaagtgtcaaaaaatctcaagtgtaggcctgcctgtgttctcatgtggatttagaacaggaggatattctatgtgtatgtatatgtacattctaatgtgtgtctcttcttattcaacattaatccttactagaaccacaagaaagtgaatgaaatctttagtaggtactcttttgaaactaggttttagaattcttgcatcactcgcgggccctaggaccctaggatgccattcttgccaggaggaggaatgagagtgatgttggccaacattcaatttgaacagagcatggaagacctttcagttcatcgggaaagaatgagggagggagaataagtcagtcatgcatcagggcatttagaaagagctatgtttctgtcacagagacagcccttttctcagaactacccagaggaggccgggcatggtggctcacgcttgtaatcccagcactttgggaggccgaggtgggcagatcacgaggtcaggagatcaagaccatcctggctaacatagtgaaaccctgtctctactaaaaaatacaaaaagttaaccaggcatgta

SEQ ID NO: 317469 - DNA, 1866 bp, Homo sapiens
tccttgtctactaaacttacaaagttagccggggcatggtggcaggtgcctgtaatcccagctacttgggaggctgaggcaggagaaggggagatacggatttaggcatgtgttgcatccacaggccttactggtgagttggaggtagagagggaaggaaaagccaagaatgttagagattcctagtttgagcaagtaatgggatggcaccgatgaatactaatgttaaaaaacaaaaaccagaaagtggaacaggattttcagggaaggtgatacattttgctttgtacttcattcctgaggaattcatgtgggattgaggagcctgagaaaggttaactaaaataggatctttctctgtccatgtacttttttgagctagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgagtcctcatttttgtgtgccagctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatctaaagacacggcagcgtagaaagattcactcgggctctgtcacagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatgaagatgtgccactcgggaataatgataccccttgtgctagagatgcaaagcctgaagacactggtagcttttaataattataaaattaataatttcttgataattataaaaatgaagtgtcaaaaaatctcaagtgtaggcctgcctgtgttctcatgtggatttagaacaggaggatattctatgtgtatgtatatgtacattctaatgtgtgtctcttcttattcaacattaatccttactagaaccacaagaaagtgaatgaaatctttagtaggtactcttttgaaactaggttttagaattcttgcatcactcgcgggccctaggaccctaggatgccattcttgccaggaggaggaatgagagtgatgttggccaacattcaatttgaacagagcatggaagacctttcagttcatcgggaaagaatgagggagggagaataagtcagtcatgcatcagggcatttagaaagagctatgtttctgtcacagagacagcccttttctcagaactacccagaggaggccgggcatggtggctcacgcttgtaatcccagcactttgggaggccgaggtgggcagatcacgaggtcaggagatcaagaccatcctggctaacatagtgaaaccctgtctctactaaaaaatacaaaaagttaaccaggcatgta

SEQ ID NO: 317470 - DNA, 5891 bp, Homo sapiens
tagttctcaaacccagcaacatgactttagacagacatgccctgtagacatgactgcctttccaattgctgcctttccttttctgactcacctgtaaacatgactcacctttccttttctgagttatttttaggcatatttgggcagacatgccctgtaaacatgactcacctttccttttctgagttattttcttgctgactctgaaatgatagacctctttcttacctatcctcagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattgaaaatgggaagcttcccttcatggccatgcttcggaacctgtgcaacctgctgcgggttggaatcagttcccgccaccatgagctcattctccagagactccagcatgggaagtcggtgatccacagtcggcagtttccattcagatttcttaacgcccatgatgccattgatgccctcgaggctcaactcagaaatcaagcattgccctttccttcgaatataacactgatgaggcggatactaactagaaatgaaaagaaccgtcccaggcggaggtttctttgccacctaagccgtcagcagcttcgtatggcaatgaggatacctgtgttgtatgagcagctcaagagggagaagctgagagtacacaaggccagacagtggaaatatgatggtgagatgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcacggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcatgtcggatctcagaactgaagagctacctaagcagacagaaagggataacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgccttcttcaggacacagtgcaacagctgatgctgccccacggaaggctgagcctggtgacggggcagtcaggacagggcaagacagccttcctggcatctcttgtgtcagccctgcaggctcctgatggggccaaggtggcaccattagtcttcttccacttttctggggctcgtcctgaccagggtcttgccctcactctgctcagacgcctctgtacctatctgcgtggccaactaaaagagccaggtgccctccccagcacctaccgaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccggtgtgtacacctggtgctgagtgtgtctagtgatgcaggcctaggggagacccttgagcagagccagggtgcccacgtgctggccttggggcctctggaggcctctgctcgggcccggctggtgagagaggagctggccctgtacgggaagcggctggaggagtcaccatttaacaaccagatgcgactgctgctggtgaagcgggaatcaggccggccgctctacctgcgcttggtcaccgatcacctgaggctcttcacgctgtatgagcaggtgtctgagagactccggaccctgcctgccactgtccccctgctgctgcagcacatcctgagcacactggagaaggagcacgggcctgatgtccttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagtttgctaggggagggccctctggagcgccctggtgcccggctgtgcctccctgatgggcccctgagaacagcagctaaacgttgctatgggaagaggccagggctagaggacacggcacacatcctcattgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgaggtgaaacaggctgatgggttaatgggatagaaac

SEQ ID NO: 317471 - DNA, 2445 bp, Homo sapiens
tagttctcaaacccagcaacatgactttagacagacatgccctgtagacatgactgcctttccaattgctgcctttccttttctgactcacctgtaaacatgactcacctttccttttctgagttatttttaggcatatttgggcagacatgccctgtaaacatgactcacctttccttttctgagttattttcttgctgactctgaaatgatagacctctttcttacctatcctcagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattgaaaatgggaagcttcccttcatggccatgcttcggaacctgtgcaacctgctgcgggttggaatcagttcccgccaccatgagctcattctccagagactccagcatgggaagtcggtgatccacagtcggcagtttccattcagatttcttaacgcccatgatgccattgatgccctcgaggctcaactcagaaatcaagcattgccctttccttcgaatataacactgatgaggcggatactaactagaaatgaaaagaaccgtcccaggcggaggtttctttgccacctaagccgtcagcagcttcgtatggcaatgaggatacctgtgttgtatgagcagctcaagagggagaagctgagagtacacaaggccagacagtggaaatatgatggtgagatgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcacggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcatgtcggatctcagaactgaagagctacctaagcagacagaaagggataacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgcccggctaattttatatttttagtagagatggggtttcaccatgttggtcatgctggtctcgaactcctgaccataggtgatccacccacctcggcctcccaaagtgctgggattacagacgtgagccattgcgcctggcccacaaatcactgttcct

SEQ ID NO: 317472 - DNA, 165 bp, Homo sapiens
ttccacccagaggggcaggtaatagccacaggcagctgggctggcagcatcagcttcttccaggtggatgggctcaaagtcaccaaggtaagaaggtccagtgttgctcttgggggaagcacaggaggacaggagtggagggtggcagacgacagacagcagcat

SEQ ID NO: 317473 - DNA, 331 bp, Homo sapiens
gtggacagggtcatcctccttggccaaagcatggatgatggaatgataaatgtggccaaacagctttactggcagcgtgtgaattccaagtgcctctttgttggtatcctcctaagaagggtacaatacctgtaagggtgcttatacttcctgcccagtgtcagaaatcagtggtctacatttcctctctacgcctgccaaagcataggacactcccacttggcagggatctccccaactctgccttcttacctctgttgcacttcaggtggatactttagcctaactctgtacccctctgtgagagtccaccctagccctagcctaccac

SEQ ID NO: 317474 - DNA, 449 bp, Homo sapiens
ccccatgctcccaggttgtgacgccaatgaagagatgaaagcaggggcagatcatgaagcatgtgggcgaaggctctgaaggttgagtagagcaaggtggtgtgtgagagcagtaagtcagacaggacacatcagtgctggtgtgtgaagggagagaacattagaggtgctattaatggagatgtagacttttcccgtggcctggtgctgccttcagatccatctggctttgaggggctgtggatacctgctgtgattcataactgccactactaccccagggtcgttggtttgattcagaagagaagaaaggggcagagacccaaatgccttcttatagtctgagcttgggagaggaggaggaggtggaggatctggccgtgaagctcacctctggagactctgaatctcatccagagcctactgaccatgtccttcaggaaaagaag

SEQ ID NO: 317475 - DNA, 585 bp, Homo sapiens
gggagcatgctgatgctggggagtcccacaccaggagcaaagggagtcagagaaatgcaggggagctgggtagagctcatgggcatatggtgcagggcagtcttcttttctagttggcttcctttttggtagagatgcaccttcagggctattgactggatctcttcaaggacagccagttccctttttttgaaattgcttctcctgtccctacaggggatggagcctccattttctcacagatgttttccaaggtacatagggtttctcagagaagagcagagaaaggtgagtcccttcttctggggttgtatatgtgcatgtacaatctcttctggactaatatttacgaacaaaattctattagggttgaaaatactttcttcctggggattcttggctgtgattgtgggtaaggttctgagagcactgggaaaggcatgtggttttattttttttcacttcactctccttggtattgtattttttttttttttttttttttgagatgaagttatgcactgtggcccaggctggagagctgcagtggcacggtcttggctcactacaacctccacctcacag

SEQ ID NO: 317476 - DNA, 489 bp, Homo sapiens
atttttcccaaaataatcatgtgggttcgtgggcatgctcatcactgctgtctgtgtggaagagaagattaaagagggatttactggactgcactgtcctaggcagcctttgctggcatctctcagcctagactgcagcccagatccttttactcaggtgcatgcatttagaacatgaaaacagtaagataaacactggtggtattattactttatattgcaagaacacttaatgatcttactatgtgtttttaatagaaacatccccactaatgaaattgtcaataaatactgctcaaaccaccttccccaaatactgaaaaacagtacatccatttctctacccttgccaagttgtctgcaaatgctctgtttttctactgaatggttagacaaacttgtgatttttttcccctttcttaacacaaatcaaaaaagtaggaaacaaaacccagtggataaaacgacattttttttttttcttgagac

SEQ ID NO: 317477 - DNA, 344 bp, Homo sapiens
tcagtggatccacactgcagacactacctgctcgttagtcactagatagccatctctgttataagacgactgtcacgtatcacggtgcttgggttcaagtgactcttattttacaggataacaaggccttgaataacgttgtcctttttttttttcttttttttctctgagttggagtctcactctgttgcccaggctggagttctggagttcagtggcatgatctcagctcactgcaacctccgcctcccgggttcaagcaattctcctacctcagcccggagcagctggaattacaggcacgtgccaccacacctggctaatttttgtaattttagtagaga

SEQ ID NO: 317478 - DNA, 5586 bp, Homo sapiens
  misc_feature (1631)..(1631): n is a, c, g, or t
  misc_feature (1638)..(1638): n is a, c, g, or t
  misc_feature (1662)..(1662): n is a, c, g, or t
  misc_feature (1711)..(1711): n is a, c, g, or t
  misc_feature (1723)..(1723): n is a, c, g, or t
  misc_feature (1738)..(1738): n is a, c, g, or t
  misc_feature (1751)..(1751): n is a, c, g, or t
  misc_feature (1783)..(1783): n is a, c, g, or t
  misc_feature (1785)..(1785): n is a, c, g, or t
  misc_feature (1797)..(1797): n is a, c, g, or t
  misc_feature (3856)..(3856): n is a, c, g, or t
  misc_feature (4725)..(4725): n is a, c, g, or t
  misc_feature (5586)..(5586): n is a, c, g, or t
ggccctaacaggaatgaaactgaggtgtcaagagggctctctgtgcacacttttggccatgacccagtgtcttctgcagtccttacgcagccacatgaggacactcagcacagagcagcctgtgtgtcccagagagtgagagaactgaagtggtgtccccaaggccacccggcaagttggtggcagagccaatacctgagctacccttaggccccgtatgtacctgcttctcatgtgacgcacagggaaattgaggcctggccccacctccctctgttgccctgctggccacatgcccaggggaagggatttccagggcttacccagagtggcattgctggggagagaccagatgcctgggctcctgggtttccccaaggggacggcccttaggaatcctgtgcctcctccactgccacccccttcacagcgggtcatccggagccgcagccagtccatggatgccatggggctgagcaacaagaagcccaacaccgtgtccaccagccacagcgggagcttcgcgcccaacaaccccgacctggccaaggcggctggaatatgagtgccctccccctccccaggccccggcccctccctggggggccctcagctctcctctgcctcctgaggcctgactccaactctctctgttgccctgctgcccacatgcccatcctaggctctggatttggtctagccactactttccatgggaggggggtgaagtgcccaggccaggacactgcggtgctgacagcttgcagcctgcagccccttcccaagctccttggccctcccctcctcctggccctttatgcattgaggtgtgacttcctgcaggtcagccctgggacagcctctgtgtctcattccttattgagtatctatctgtttgctggggactgggctgctgtgtgggcacctactgtcaagccttgggtttctgggagcacctactgtgtgtcgggctgtgggcacccactgtgtgtcaggccctgggctgctgtgtggacatgcactctgtgagcatctactgtgggcctggccctgagtacctgtgagcacccactgtgtgtcaggtcctgggctgctgtgtgggcatcaactctgtgagcgcctactgtgtgcgcagccctgggctgctgtgtgagaacctactgtgtgtcagaaaatggactgctatgtgagcacatcgtgtgtgataagccctagatgtcagtgaacacctactgtgtgtcaggaagtgagctgttgtgtgggtactttctctgtgagcacctcctactgtgtgtccgcagcagccagggcctctgtggtgtggctgcctattgtgtgtcgggaatctggcttctgtgtgagcatctccagagggagcacctcctgtgtgatcactgactgttgtccaggttctgggattctgctgctcacactcaggagtgctgggcacatggatgaatacggcctatggctgtgggcctcactgctgtccactgcctagtggccaccccaggacactgcacccactgctgtgctccccacccatccatccagccacccatccatccacccacccatccatccatccacccacccatccacccatctagctatccacccacccacccatncacccanctacccatctacccatccacccanccacccactcatccatccacccacccatccacccacccatccacccatnaatccatccatncacccacccatccanccatccatccatncatccatccatccatccatccatccatccatntntatccatccctntatctccatccatccatccacccacccaccgatccatccatccatccatcctttattgactgtctactgcatgccaagccctgcgctcagtgctgtgaggctatgtcacgtggcaggagggaattccccgacctctgctgtccagcagtcaccaagcacactgtcatgcgaggagcaggcccaacctcccccaacccagttttatcaaccactcccttcctctccaccagagtgacccagcctcctgtgggtggccgagaggggccccagggacaggaccaggccagcagcacccaccatggcagtaaccggacccatttctgttttgtttttgcacaactctccctctctctgtgtttcctcctttcattctactctctctccttgtttttttgttccctcctcccttccctttccccgtcctgtggcctctctgccctttggctctctgtttctccttccttcttgcacctgtctttttttgctccctctcctccttcccttctccgctcttctcaccctcgctttttcctttcggccttcccctggcttccttctctgtctctgaccctccctgggcctgtgtctgtgtccttgcgtccctgtctctctggatttccctctgtgcccatctggtgtgccctcgctggctcacgcgtgtccctgtctccgggtaactgtctgtccatctctcccccgtctcccttgtcctctgtctctccttgtgcttctcgccttcctttccccggccctatctctcccattgcctcctgcaccgttctcttcctttttctgtctgtcttcctcctttccctgcctctcctcctctctgtgtctccctcccaccatctctcttgctctctgactctctctctgtctctctctctctgcccccgccctctgctgcttgccagtcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagaggtgggtgagtgggggacagtgccccattcccctgcanccccatccctgagccccattcggtggcaaagcaaggcaggcagaagggagtgcccgcccctctgcctctccatccccactagtgacagctgtgtggtcaagtccctgctgcgtgtcgggcaccagggccagcacgtcacctaacgtgccacatgcagatcaagaagcggtaggtcagaggagtcaaggggcttgcccagatcacacagccagtgatgggcagagctaggatctgagccctgatctgtctagggccagcatccgtgctcttcccacggccccagcgcatgtgggagggcctagtgctggttttcagggtggccacagatgggcctggggggtccatgagtgtgggcagcatgagggcagtgagcccaggccagcagcagggctgcccccggacatcagaggctagctcccggctgcctccccgatattaaccatgtgtgaccttgggcgagtcactgacctcctctgagccttactgtcccaacctggaaaagggacaagaacacaacccatggcatggggctgctgtggggactcagggcactgcgtgtgaggccagggccaggtcccctgagagggctccaggacgggagtgggcattgtccttgctgctgccagagctccgcatgctgtgagtcctgggttcaggtcttggcactgccacgtcctagctgtgcgtccctgggcaggttccttatccataatgggacagctatacctgctcctgtggagaggacctgggaggagtcccatcctgtcccatatagccccatcagtgccaaccccatcactggccaggctagccagggagcccacaagactgctccagggctggccctgagtataggggcgtgggtatgnggcaggaggcaccgtgactcccctcaccgcctgggcctcacgctacgcctgatgccaggcctggtgctgaatccccccgctgcccccgtgtgccccgcagggagagccctccggctggtcagaagaccccagacagcgggcacgtctcacaggagcccaagtcggagaactcatccactcagagctccccagagatgcccacgaccaagaacaggttggggctcagggcacgtggggcttgggggcttgggagtggtgaaccgtccttcccctcccctgcctgggcccgggacagcacaggagccttgactgtgccacagcagggtgtcagggggacctgggcattctctggggccctcctttgacatatacccagcgagcactttgtgcacgcccagccccgcgcccggctctggagcacagaggtgccctgcgcataggtccccgcctcacggccgcaggtccatcagaacgcggcctcataggctgttgccggatcatggtgataggaggaacccgaagcagggttggggggatgaagagggactgggggcagaggtgttttagatgggtcctcggggagacacctccatggggtgacatttgaattgggaactgaaccagccctgctaggactggcatggcagaggagctcggccagtgcagaggcctggggcacactccagggacagaaagaagggtggctgggagtggtgacgtatgcctggagtccacctacctgggaggctgaagcaggaggatgattttagcccaggagttggaggctgcagtgagctatgatcatgcctgtgaatagccactgcactctagcctggacatcatagcaagactccattgctn

SEQ ID NO: 317479 - DNA, 431 bp, Homo sapiens
gttctgctgtgtgactctgggcaagtcactctccctctctgggcatgtctgctacaaatggacaagattatttcagagagtttgagacagctccgtgtggagagcttagcccctggaggcagcacaaggaggatgtgatatgtgggggagtgaccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317480 - DNA, 671 bp, Homo sapiens
actgagccaagcacttcatccctttcagtcctggctgccaccaaagtacagggttccctcctatttggcagactaggaaagtgaggcacagagcggccaagtgacctcctcaggctgcccagctggtcagtggcagagtggggctttgagtgcaggtctgtctgatgtggggtctgctatcagccgtgacacctgctatcggcgaaggacctgcatctgggagtgggttggctttctggccttgtttccaaaagccccatgctcagcctcacccactcccctggcccccacctcccactgcaggagcatttcaattactactcactggacgctgccctcggccaccttgtcttctcactcaagtacgatgtcatcggggaccaagagcacctgcggctgctgctcaggtgagggtggtgggggagtcctgagatggcaggaagggctgaggtcttacaatctcagagcccatctcatttgacccactctcttcatcaaggcccatagaggggcagggatttgcttgaggttgcacagcaagttagtacccgagtcagcctgacacccatcatcacctctggtcctcgctgtggtccacccccttctggccttactttgtggggggtggggttcccattttcctgtcctgctgcccaggccttcatcgtgtg

SEQ ID NO: 317481 - DNA, 4276 bp, Homo sapiens
  misc_feature (1)..(1): n is a, c, g, or t
ngggagctcagcgctgcggggcccggacccgggcgcgcgcgggccaggagccggctgggccagctgaagtgccgccgggcgggggccgggccgggccgcgctcaggatggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317482 - DNA, 6425 bp, Homo sapiens
  misc_feature (1)..(1): n is a, c, g, or t
  misc_feature (2696)..(2696): n is a, c, g, or t
  misc_feature (2703)..(2703): n is a, c, g, or t
  misc_feature (2727)..(2727): n is a, c, g, or t
  misc_feature (2776)..(2776): n is a, c, g, or t
  misc_feature (2788)..(2788): n is a, c, g, or t
  misc_feature (2803)..(2803): n is a, c, g, or t
  misc_feature (2816)..(2816): n is a, c, g, or t
  misc_feature (2848)..(2848): n is a, c, g, or t
  misc_feature (2850)..(2850): n is a, c, g, or t
  misc_feature (2862)..(2862): n is a, c, g, or t
ngggagctcagcgctgcggggcccggacccgggcgcgcgcgggccaggagccggctgggccagctgaagtgccgccgggcgggggccgggccgggccgcgctcaggatggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatgagtgccctccccctccccaggccccggcccctccctggggggccctcagctctcctctgcctcctgaggcctgactccaactctctctgttgccctgctgcccacatgcccatcctaggctctggatttggtctagccactactttccatgggaggggggtgaagtgcccaggccaggacactgcggtgctgacagcttgcagcctgcagccccttcccaagctccttggccctcccctcctcctggccctttatgcattgaggtgtgacttcctgcaggtcagccctgggacagcctctgtgtctcattccttattgagtatctatctgtttgctggggactgggctgctgtgtgggcacctactgtcaagccttgggtttctgggagcacctactgtgtgtcgggctgtgggcacccactgtgtgtcaggccctgggctgctgtgtggacatgcactctgtgagcatctactgtgggcctggccctgagtacctgtgagcacccactgtgtgtcaggtcctgggctgctgtgtgggcatcaactctgtgagcgcctactgtgtgcgcagccctgggctgctgtgtgagaacctactgtgtgtcagaaaatggactgctatgtgagcacatcgtgtgtgataagccctagatgtcagtgaacacctactgtgtgtcaggaagtgagctgttgtgtgggtactttctctgtgagcacctcctactgtgtgtccgcagcagccagggcctctgtggtgtggctgcctattgtgtgtcgggaatctggcttctgtgtgagcatctccagagggagcacctcctgtgtgatcactgactgttgtccaggttctgggattctgctgctcacactcaggagtgctgggcacatggatgaatacggcctatggctgtgggcctcactgctgtccactgcctagtggccaccccaggacactgcacccactgctgtgctccccacccatccatccagccacccatccatccacccacccatccatccatccacccacccatccacccatctagctatccacccacccacccatncacccanctacccatctacccatccacccanccacccactcatccatccacccacccatccacccacccatccacccatnaatccatccatncacccacccatccanccatccatccatncatccatccatccatccatccatccatccatntntatccatccctntatctccatccatccatccacccacccaccgatccatccatccatccatcctttattgactgtctactgcatgccaagccctgcgctcagtgctgtgaggctatgtcacgtggcaggagggaattccccgacctctgctgtccagcagtcaccaagcacactgtcatgcgaggagcaggcccaacctcccccaacccagttttatcaaccactcccttcctctccaccagagtgacccagcctcctgtgggtggccgagaggggccccagggacaggaccaggccagcagcacccaccatggcagtaaccggacccatttctgttttgtttttgcacaactctccctctctctgtgtttcctcctttcattctactctctctccttgtttttttgttccctcctcccttccctttccccgtcctgtggcctctctgccctttggctctctgtttctccttccttcttgcacctgtctttttttgctccctctcctccttcccttctccgctcttctcaccctcgctttttcctttcggccttcccctggcttccttctctgtctctgaccctccctgggcctgtgtctgtgtccttgcgtccctgtctctctggatttccctctgtgcccatctggtgtgccctcgctggctcacgcgtgtccctgtctccgggtaactgtctgtccatctctcccccgtctcccttgtcctctgtctctccttgtgcttctcgccttcctttccccggccctatctctcccattgcctcctgcaccgttctcttcctttttctgtctgtcttcctcctttccctgcctctcctcctctctgtgtctccctcccaccatctctcttgctctctgactctctctctgtctctctctctctgcccccgccctctgctgcttgccagtcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317483 - DNA, 3533 bp, Homo sapiens
  misc_feature (1)..(1): n is a, c, g, or t
ngggagctcagcgctgcggggcccggacccgggcgcgcgcgggccaggagccggctgggccagctgaagtgccgccgggcgggggccgggccgggccgcgctcaggatggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctgtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317484 - DNA, 4423 bp, Homo sapiens
tgtccaggctctgttatctggaaaaggggctcttgacgggctcctgaacccaccagaatgtgcagagaagaggtcccaggtgggagccgagagggggctgagggcagatccccaagagagaagtgattggtgtgagagaggatctcaatttcttcgtgtctaaaatggggaaactgcagcgccacttaccctgcctagggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317485 - DNA, 4307 bp, Homo sapiens
  misc_feature (1)..(1): n is a, c, g, or t
ngggagctcagcgctgcggggcccggacccgggcgcgcgcgggccaggagccggctgggccagctgaagtgccgccgggcgggggccgggccgggccgcgctcaggatggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccagtgaggtggctccctcctgcccccctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317486 - DNA, 4416 bp, Homo sapiens
gatctccacagcggtggagaggaggaagggtgaacgccgtggtggagtggtccatgtggacctgctcccctttgctgccaggaggttaatacctctgccaaccgaggccaccctccctcggacccccattcggaagaagcagacccaagttcgaattctgacattgccactgagcagccgtacaacttttgggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317487 - DNA, 4089 bp, Homo sapiens
actgagccaagcacttcatccctttcagtcctggctgccaccaaagtacagggttccctcctatttggcagactaggaaagtgaggcacagagcggccaagtgacctcctcaggctgcccagctggtcagtggcagagtggggctttgagtgcaggtctgtctgatgtggggtctgctatcagccgtgacacctgctatcggcgaaggacctgcatctgggagtgggttggctttctggccttgtttccaaaagccccatgctcagcctcacccactcccctggcccccacctcccactgcaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317488 - DNA, 3646 bp, Homo sapiens
agcagagctgcagcggcggccgcgggcaccagagtgccgagcccaggacgcccccggcccaggcccttggggtttggtgccagctgcggggcgcctgggcttggggaagaaaccttgtgtacgcacacctgcacacacacacagtctccggaggttaatacctctgccaaccgaggccaccacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317489 - DNA, 5181 bp, Homo sapiens
  misc_feature (1452)..(1452): n is a, c, g, or t
  misc_feature (1459)..(1459): n is a, c, g, or t
  misc_feature (1483)..(1483): n is a, c, g, or t
  misc_feature (1532)..(1532): n is a, c, g, or t
  misc_feature (1544)..(1544): n is a, c, g, or t
  misc_feature (1559)..(1559): n is a, c, g, or t
  misc_feature (1572)..(1572): n is a, c, g, or t
  misc_feature (1604)..(1604): n is a, c, g, or t
  misc_feature (1606)..(1606): n is a, c, g, or t
  misc_feature (1618)..(1618): n is a, c, g, or t
atctcctccacactgggagtttccaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatgagtgccctccccctccccaggccccggcccctccctggggggccctcagctctcctctgcctcctgaggcctgactccaactctctctgttgccctgctgcccacatgcccatcctaggctctggatttggtctagccactactttccatgggaggggggtgaagtgcccaggccaggacactgcggtgctgacagcttgcagcctgcagccccttcccaagctccttggccctcccctcctcctggccctttatgcattgaggtgtgacttcctgcaggtcagccctgggacagcctctgtgtctcattccttattgagtatctatctgtttgctggggactgggctgctgtgtgggcacctactgtcaagccttgggtttctgggagcacctactgtgtgtcgggctgtgggcacccactgtgtgtcaggccctgggctgctgtgtggacatgcactctgtgagcatctactgtgggcctggccctgagtacctgtgagcacccactgtgtgtcaggtcctgggctgctgtgtgggcatcaactctgtgagcgcctactgtgtgcgcagccctgggctgctgtgtgagaacctactgtgtgtcagaaaatggactgctatgtgagcacatcgtgtgtgataagccctagatgtcagtgaacacctactgtgtgtcaggaagtgagctgttgtgtgggtactttctctgtgagcacctcctactgtgtgtccgcagcagccagggcctctgtggtgtggctgcctattgtgtgtcgggaatctggcttctgtgtgagcatctccagagggagcacctcctgtgtgatcactgactgttgtccaggttctgggattctgctgctcacactcaggagtgctgggcacatggatgaatacggcctatggctgtgggcctcactgctgtccactgcctagtggccaccccaggacactgcacccactgctgtgctccccacccatccatccagccacccatccatccacccacccatccatccatccacccacccatccacccatctagctatccacccacccacccatncacccanctacccatctacccatccacccanccacccactcatccatccacccacccatccacccacccatccacccatnaatccatccatncacccacccatccanccatccatccatncatccatccatccatccatccatccatccatntntatccatccctntatctccatccatccatccacccacccaccgatccatccatccatccatcctttattgactgtctactgcatgccaagccctgcgctcagtgctgtgaggctatgtcacgtggcaggagggaattccccgacctctgctgtccagcagtcaccaagcacactgtcatgcgaggagcaggcccaacctcccccaacccagttttatcaaccactcccttcctctccaccagagtgacccagcctcctgtgggtggccgagaggggccccagggacaggaccaggccagcagcacccaccatggcagtaaccggacccatttctgttttgtttttgcacaactctccctctctctgtgtttcctcctttcattctactctctctccttgtttttttgttccctcctcccttccctttccccgtcctgtggcctctctgccctttggctctctgtttctccttccttcttgcacctgtctttttttgctccctctcctccttcccttctccgctcttctcaccctcgctttttcctttcggccttcccctggcttccttctctgtctctgaccctccctgggcctgtgtctgtgtccttgcgtccctgtctctctggatttccctctgtgcccatctggtgtgccctcgctggctcacgcgtgtccctgtctccgggtaactgtctgtccatctctcccccgtctcccttgtcctctgtctctccttgtgcttctcgccttcctttccccggccctatctctcccattgcctcctgcaccgttctcttcctttttctgtctgtcttcctcctttccctgcctctcctcctctctgtgtctccctcccaccatctctcttgctctctgactctctctctgtctctctctctctgcccccgccctctgctgcttgccagtcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317490 - DNA, 1385 bp, Homo sapiens
gggagtagtgtgattgaggtggagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317491 - DNA, 2528 bp, Homo sapiens
  misc_feature (1)..(1): n is a, c, g, or t
ngggagctcagcgctgcggggcccggacccgggcgcgcgcgggccaggagccggctgggccagctgaagtgccgccgggcgggggccgggccgggccgcgctcaggatggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccagacgccggcaagttgggggaccctgcgtgtcccgagatcaagatccagctggaagcatctgagcagcacatgccccagctgggctgtagccggggcaacccctctgaaggtgaaactggacaatgaggcacagaagcacaaggggagaggtgccgtggtaaagcccagggagatacaccctctggcctgaagacaacaccaaggcggtgggacttgccagggcactcgccacgcaaccacggcaacacaaagggaggaatagcaggaacaagaagaaacaacgggcagagtgaacagacagatagccacccgccaatgataggagcggagccagcacgcaaacaagcagcaaagcacagagacccacgaaagaaaaacaaaaaacagcacagacagaagggggagaaagaaaacagacagaaacaaagagaagaagaaaacgacaagaaga

SEQ ID NO: 317492 - DNA, 630 bp, Homo sapiens
gattcaaaggcagggtggaaatctttagatggttattaagaaacaaagaataaaatggaaactgatggtgttaaaacaaagatcgttgttgtttttttttgagatagggtcccactctgtcacccaggttagagtgcagtgatgcaatcacggctaactgcagcctcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317493 - DNA, 867 bp, Homo sapiens
  misc_feature (1)..(1): n is a, c, g, or t
ngggagctcagcgctgcggggcccggacccgggcgcgcgcgggccaggagccggctgggccagctgaagtgccgccgggcgggggccgggccgggccgcgctcaggatggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggtatggctggatctgggcacagctcactgagggtgggtgagtaactggaagactgagcatttattaagcaccttctgtgtgccagatactttcccaaggttctctcatttaatcctcacaataaccctgtgaagtccaca

SEQ ID NO: 317494 - DNA, 365 bp, Homo sapiens
gcggccgcgggcaccagagtgccgagcccaggacgcccccggcccaggcccttgggtgagtgcgccccgccagggctgcggccctggaaaggggaaggggacagaggtgtccagactcccgtcggctcgcagcgaagaccccgcgcgggcgggcggggacggagggtgggggcgaacgcgtgggggacccgggtctccaggggcgaggggtgggcgcagctgggctcgcgcagcccggtcttgacagcagctggagaagtggggggaggcctggactgagccggctgaacccccagcctgttggacttggtccaggccgcggccagggggctttggtcccacccccctgggtgggtggggagtcc

SEQ ID NO: 317495 - DNA, 3297 bp, Homo sapiens
agcagagctgcagcggcggccgcgggcaccagagtgccgagcccaggacgcccccggcccaggcccttggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317496 - DNA, 449 bp, Homo sapiens
agcagagctgcagcggcggccgcgggcaccagagtgccgagcccaggacgcccccggcccaggcccttggggtttggtgccagctgcggggcgcctgggcttggggaagaaaccttgtgtacgcacacctgcacacacacacagtctccggaggttaatacctctgccaaccgaggccaccctccctcggacccccattcggaagaagcagacccaagttcgaattctgacattgccactgagcagccgtacaacttttgggtggacaagtccttcacttctcgccggagtgtgtggaggagcgatgggcagaaccagcacttccctcaggcactagacctgtcacgagtgaacttagttccctcctatactccttcactctaccctaagctatttcacctcttggaaccggcttctcatctgtataatggagatgacatttgtacctc

SEQ ID NO: 317497 - DNA, 4402 bp, Homo sapiens
agcagagctgcagcggcggccgcgggcaccagagtgccgagcccaggacgcccccggcccaggcccttgggttaatacctctgccaaccgaggccaccctccctcggacccccattcggaagaagcagacccaagttcgaattctgacattgccactgagcagccgtacaacttttgggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317498 - DNA, 3356 bp, Homo sapiens
  misc_feature (1)..(1): n is a, c, g, or t
ngggagctcagcgctgcggggcccggacccgggcgcgcgcgggccaggagccggctgggccagctgaagtgccgccgggcgggggccgggccgggccgcgctcaggatggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317499 - DNA, 4284 bp, Homo sapiens
ggcggcggcggcaccatgagcggccggaagcgcagcttcaccttcggggcctacggcggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317500 - DNA, 4252 bp, Homo sapiens
  misc_feature (1)..(1): n is a, c, g, or t
ngggagctcagcgctgcggggcccggacccgggcgcgcgcgggccaggagccggctgggccagctgaagtgccgccgggcgggggccgggccgggccgcgctcaggatggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317501 - DNA, 4104 bp, Homo sapiens
  misc_feature (1)..(1): n is a, c, g, or t
ngggagctcagcgctgcggggcccggacccgggcgcgcgcgggccaggagccggctgggccagctgaagtgccgccgggcgggggccgggccgggccgcgctcaggatggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317502 - DNA, 3563 bp, Homo sapiens
tctagaggatccctgtctgtgtgggcgtgtggttctgggtcggtctggtgcggggctcatgcttctcacccgtgtggttctcgtgtggttctgtgctgacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317503 - DNA, 1856 bp, Homo sapiens
aaagcaggctgttactggtcgcggatttaaggaggcctggcccaggaggggctcggggtggacaccggctaatggggcactgtctgtggcagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggtaccaggacaaggcagcttccccacaaagcagggctaccttggggtaggagggggacagggctgggcaccagttcccatgccccatgcagtggatgtgatgtgactgcccctgacttggaggacagcgggcaggtcattgtccagcctagggtggctgggtggattggagggctggtttcttccggaagggtctcggaggataatgggggatggcaaggaagaaagttaagggtggggttggagcgcactggtgccgaccgcccacctatgcccccgtctccctggtgcctccccgcggccagtgtgaggtggctccctcctgcccccctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317504 - DNA, 1786 bp, Homo sapiens
  misc_feature (1)..(1): n is a, c, g, or t
ngggagctcagcgctgcggggcccggacccgggcgcgcgcgggccaggagccggctgggccagctgaagtgccgccgggcgggggccgggccgggccgcgctcaggatggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatactgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaaaaaaaaaa

SEQ ID NO: 317505 - DNA, 415 bp, Homo sapiens
cggccgcgttgccaaggtgacccgggcgcgggaaggcggctccggctcgcgcgggccgggccgggcggcggcggcggcaccatgagcggccggaagcgcagcttcaccttcggggcctacggcgggtagggcgtggcgcggcgcggggcggggcgcgtgcgcgcgtgtgcgtgtgcacgcgtgggggggagcccgtgcggggtgtgctcgcgtttgggcgggtgggcctgggctatgactgctgtgggggctgagcgtttgacctcagtgcgcgcatggctgtcgtgctgtggcgcctgtgtgtgtgtgtttctgtttctgtgtctgtgtgtgttcccattgcgtgtccatgtgcatgtgtggggaggtgagtgcagggtggacattgctgtgtttgtgtctaagcacatgatag

SEQ ID NO: 317506 - DNA, 490 bp, Homo sapiens
gcacgaggtgcattaagtgtcaaacaatgaaacaattgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317507 - DNA, 601 bp, Homo sapiens
  misc_feature (239)..(239): n is a, c, g, or t
cattcctttgccccaattggttccacttggtttgaccacacgtaaagccaccttggccaatttgccaatccggaccagatagccatttcttggcccacccacgtgtaccgccgggtaaccctccatcttacatcttctgaatgttttttaaaaatgagcttttaacacacacaggaagaaggggaaaaggaatccccctctaatatttgctctttgttttcctctcgaaagaatatgtnggcacacacctcgtttttgggagatttaatttgtgcacggtcacagcacacaccacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317508 - DNA, 2378 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317509 - DNA, 2287 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaa

SEQ ID NO: 317510 - DNA, 2845 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacatttataaaatggctcttgtggtttaatagtgtgtaaaaatacccttgtgaatttggaacaagggagatattctcctaggcgagatcctttcttgccaactccgtttcccttatagcaaatgtagtaaatgaggatgaagtccctttgagagcatgtgggggttgggtgaccaagggagaccaggttgttcctgtcacattcctagaggaagatgagtggataccccgacacccagtgcaaaaacttttgacctattatgtactcagttcaattgggtgagaccgaagatcttgatttcattcatctgtgtgtcttaaaaacacttgtgtctttaagtctattatggggctttgcttattctttgagtcttggaaagttatcatttgtgcattttaaatttagaaaacctttattaatcgttggtgtggggtcacgctatcaggaagcctgtttactgggttcccttcaggc

SEQ ID NO: 317511 - DNA, 2491 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacatttaaaattcctctccacttctcattatcttctatttcttaaactatatcttacctttacaacccttctcattctcctattctctacctccctcttcctcaaaccctttttattaca

SEQ ID NO: 317512 - DNA, 2462 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacatttacctttattaacaaaacaaaaaacataaaaaaaagaacaaaacaccaaaaccactcaacaaggacgcaccacgcgaagcacacag

SEQ ID NO: 317513 - DNA, 2673 bp, Homo sapiens
  misc_feature (2362)..(2363): n is a, c, g, or t
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaaaaaaaaaaaaaaaaaaaaaaaaaaaaaaaaaattaaaaaaaaaaaaaaaaaaaaaaaaacaaaattaaacttatnnatactttataatcaattttttcccaattttcttctatttacaactacttattacctttctacaaacttataatctatcaattaataaactcccctatctaaacctactttacaacctaccactttctaacaacctctcttactaaaatatcaccatcccttactcttattatacattaaaatccttttctcctttaataatctctctacctctactatttcttcatccccttaattcttttttaaacaaccttcttttcttctaacattctaataatacactaacacttctttcatctttaaccatctcc

SEQ ID NO: 317514 - DNA, 2023 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317515 - DNA, 2324 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggtttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317516 - DNA, 2275 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcaggagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317517 - DNA, 2284 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcagaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317518 - DNA, 2196 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccggagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317519 - DNA, 1961 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcaggtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317520 - DNA, 1955 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgagcggagaagacacggcactagcgacacttgtgccggtcatgcgcgacacctgcccagccagacacgatgtcacgaatctcacaggcacactgattgcaacaagacaaggtacccgcggccaaggacccacgcgcacgcatcctcggccctgtcggaccaccacggggacagcctcaggcggccccaccaggggcgcaagccgcactacgccaccagcgggctg

SEQ ID NO: 317521 - DNA, 1842 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctacctgaatggagtatgaatgatgcactaagggattgtaattgatcatatccaacatttatccttcgcctataagattcaatttttccattccatgaatcttttgttaatcgaattcatttatatggtttaacccg

SEQ ID NO: 317522 - DNA, 1690 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggagcacacgaatgttcaggtaccgagactcgattcgtatcatgta

SEQ ID NO: 317523 - DNA, 1599 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagacccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317524 - DNA, 1716 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaatgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317525 - DNA, 1466 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcaggcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317526 - DNA, 1138 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacctctgcccgtgtcccacctctccccgtggcccacctctcgggatcctctaga

SEQ ID NO: 317527 - DNA, 2217 bp, Homo sapiens
  misc_feature (72)..(72): n is a, c, g, or t
  misc_feature (93)..(93): n is a, c, g, or t
  misc_feature (97)..(97): n is a, c, g, or t
gggggccccccccccccccccccccgggggggaaaaaaaaaaaaagggggcgccccgggggcccaaaggggnccgggaaagggaaaagggaanaaancccgggccgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317528 - DNA, 2233 bp, Homo sapiens
  misc_feature (121)..(122): n is a, c, g, or t
  misc_feature (124)..(124): n is a, c, g, or t
agctgttcacatgctttctacagtatctttataaataaaaggtcctttatccaccaaacaacacctgaaatgatctaagttcaaaacattagtatacaaggacctagataaattggcctcnngntcgctgcggaatcggcacgaggctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317529 - DNA, 2287 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317530 - DNA, 1775 bp, Homo sapiens
ccttttatccggatattgatgttatttctattgtgcttctcgtgttgtgatattccgtattcgttggataacatttctctctataatgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317531 - DNA, 1162 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgccaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317532 - DNA, 1153 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgccaggcaggccggtggggtccttgtggg

SEQ ID NO: 317533 - DNA, 1417 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317534 - DNA, 1652 bp, Homo sapiens
  misc_feature (1125)..(1126): n is a, c, g, or t
  misc_feature (1137)..(1137): n is a, c, g, or t
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcaccagcgggagcttgatatcccttgtctgtaacatagaccccgggtactgcgggaggggagggctgctggggaggatggcagctctnnattcccttgcngacaaatttcatcctgaagtgcagtgatgggctagtcaccaaagaatgaaattcagcaccggggacatagatcatgataccttaccaacttcttcccaacattgtgtccacctccgtgttgctataacatgtgtcactcatgaacggctatttcttatcgcggccatagccccctattcctacactaaacgctgtagatgtcttcccccctgtggcatcagtaaggaaccaccaagacttcgggcactcgcctactatgttccaaacaccttttttggacaccactttacccctggcggcctaaatttagatactacataacccctgcctgttatacatcgctttgccattttcaacgcgaatggaaaatgcctagtttgcacccccttctagacaatgcttttattgccccccccaatgcccccagtgttggagagcaatcaaccccttgtcaattcactcctacttttcacccggggtaatcccgcgctggcccctctaaatcgccattgatc

SEQ ID NO: 317535 - DNA, 2330 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317536 - DNA, 2131 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317537 - DNA, 2169 bp, Homo sapiens
cgcagagcggatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgagacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattta

SEQ ID NO: 317538 - DNA, 2743 bp, Homo sapiens
tcaaacaagtaattttatttaccttttcatgttttaccaacctgtcctccccctaggccttgagtgttttcacgttttcctttcagtgtttgggagctggggactactagggtatcagcattcatttccgccggcgggccccccgcccaggtttcttttctcctcggcgccttcgggtgggggcaggaggagcagagggagttggggatgggggtggttttaagccccaaataccatctcatccctgagtagtcttctccaaccctggtcacccactttcaagtccagcccccattttcctccctaaactcccatcctcagccctgaaaaatcctcttctccgctcctagcatatccacggatccaaccctaagtgactctcaaacctaccctctccctcaatttgtgacccagccccaaactccatcattgctctcctgtccctcaccatatatcccttcttttgctcagtctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagaagagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtgaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcgagagctggagagcttggtcccaaggctaggtgtgaagttagccaaaaccccaatgcggacatggggtccccggccaggcttcacctttgcttcccttcgtgctcgaacctgccatgtgtgtcacaggcacagctttgaagcgaagctgacaccttgcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctaccttttacctacaccgcagaggtgaccagtgaaaccttcaacaaagaggccttcctggcctctcggggcctcactcgtggctattggacccagctcagcatgctgattccaggcccgggcttctccagacacccccgaggcaacacgccatccctcagccttcttcgcggtggagacccctaccagcttctccagggagacgggactgccctgatgcctcctgtgcccccacatccaccccggggtgtttttgtccctgagctcaacatccaaaacaaacagtcactgaagatccacgtggtggaggccgggaaggagtttgaccttgtcatggtgttttgggagcttttggtcctgctcccccatgtggccctggagctgcagtttgtaggtgatggcctgccccccgaaagcgacgagcagcattttaccctgcagagggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattggatttaactccgggtttgctctcaaggatacgtggctgaggtctctgccccggttacagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaaaaaaaga

SEQ ID NO: 317539 - DNA, 2860 bp, Homo sapiens
tcaaacaagtaattttatttaccttttcatgttttaccaacctgtcctccccctaggccttgagtgttttcacgttttcctttcagtgtttgggagctggggactactagggtatcagcattcatttccgccggcgggccccccgcccaggtttcttttctcctcggcgccttcgggtgggggcaggaggagcagagggagttggggatgggggtggttttaagccccaaataccatctcatccctgagtagtcttctccaaccctggtcacccactttcaagtccagcccccattttcctccctaaactcccatcctcagccctgaaaaatcctcttctccgctcctagcatatccacggatccaaccctaagtgactctcaaacctaccctctccctcaatttgtgacccagccccaaactccatcattgctctcctgtccctcaccatatatcccttcttttgctcagtctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagaagagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtgaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcgagagctggagagcttggtcccaaggctaggtgtgaagttagccaaaaccccaatgcggacatggggtccccggccaggcttcacctttgcttcccttcgtgctcgaacctgccatgtgtgtcacaggcacagctttgaagcgaagctgacaccttgcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctaccttttacctacaccgcagaggtgaccagtgaaaccttcaacaaagaggccttcctggcctctcggggcctcactcgtggctattggacccagctcagcatgctgattccaggcccgggcttctccagacacccccgaggcaacacgccatccctcagccttcttcgcggtggagacccctaccagcttctccagggagacgggactgccctgatgcctcctgtgcccccacatccaccccggggtgtttttggctcatggcaggattactacacatggcggggcctcagcttggactcccccatagccgtgcttctcacctacccgctgaccgtgtactacgtcatcacccacctggtgccccagtccttccctgagctcaacatccaaaacaaacagtcactgaagatccacgtggtggaggccgggaaggagtttgaccttgtcatggtgttttgggagcttttggtcctgctcccccatgtggccctggagctgcagtttgtaggtgatggcctgccccccgaaagcgacgagcagcattttaccctgcagagggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattggatttaactccgggtttgctctcaaggatacgtggctgaggtctctgccccggttacagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaaaaaaaga

SEQ ID NO: 317540 - DNA, 1081 bp, Homo sapiens
ccttctttcatcctctcaggagacccctaccagcttctccagggagacgggactgccctgatgcctcctgtgcccccacatccaccccggggtgtttttggctcatggcaggattactacacatggcggggcctcagcttggactcccccatagccgtgcttctcacctacccgctgaccgtgtactacgtcatcacccacctggtgccccagtccttccctgagctcaacatccaaaacaaacagtcactgaagatccacgtggtggaggccgggaaggagtttgaccttgtcatggtgttttgggagcttttggtcctgctcccccatgtggccctggagctgcagtttgtaggtgatggcctgccccccgaaagcgacgagcagcattttaccctgcagagggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattggatttaactccgggtttgctctcaaggatacgtggctgaggtctctgccccggttacagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaaaaaaaga

SEQ ID NO: 317541 - DNA, 2431 bp, Homo sapiens
gtgtccatcccccttcgtgtgtccatcccccttcgtgtgtccatccgcttcgtgtgtccatcccccttcgtcatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagaagagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtgaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcgagagctggagagcttggtcccaaggctaggtgtgaagttagccaaaaccccaatgcggacatggggtccccggccaggcttcacctttgcttcccttcgtgctcgaacctgccatgtgtgtcacaggcacagctttgaagcgaagctgacaccttgcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctaccttttacctacaccgcagaggtgaccagtgaaaccttcaacaaagaggccttcctggcctctcggggcctcactcgtggctattggacccagctcagcatgctgattccaggcccgggcttctccagacacccccgaggcaacacgccatccctcagccttcttcgcggtggagacccctaccagcttctccagggagacgggactgccctgatgcctcctgtgcccccacatccaccccggggtgtttttggctcatggcaggattactacacatggcggggcctcagcttggactcccccatagccgtgcttctcacctacccgctgaccgtgtactacgtcatcacccacctggtgccccagtccttccctgagctcaacatccaaaacaaacagtcactgaagatccacgtggtggaggccgggaaggagtttgaccttgtcatggtgttttgggagcttttggtcctgctcccccatgtggccctggagctgcagtttgtaggtgatggcctgccccccgaaagcgacgagcagcattttaccctgcagagggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattggatttaactccgggtttgctctcaaggatacgtggctgaggtctctgccccggttacagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaaaaaaaga

SEQ ID NO: 317542 - DNA, 505 bp, Homo sapiens
ggcggctgcaggtaccggaggagtggggcggccgggaggggctaggtctaccggggctgcccgccacgcagatccgagcccagggaaccccctgtttccctttcccataccccacagacgcatccaaaatgcttccctccccaccaaaccgttcccgataggattagccctctctcctctctagccttaatttaaactctgcttttgagggtgtgaactctccaattttaagccccaaataccatctcatccctgagtagtcttctccaaccctggtcacccactttcaagtccagcccccattttcctccctaaactcccatcctcagccctgaaaaatcctcttctccgctcctagcatatccacggatccaaccctaagtgactctcaaacctaccctctccctcaatttgtgacccagccccaaactccatcattgctctcctgtccctcaccatatatcccttcttttgctcagtctgggccggggccctgtgccgctga

SEQ ID NO: 317543 - DNA, 3841 bp, Homo sapiens
agctgtttaaatatgctaatgaaaggatagggcctgaccagtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgtgtcaatttccctcaggttctattttcttaaaccaacctttaaaattgtcacctctgttaaggttgaactttgccaaaaaaaaaagaagttactttgtaatttttggggaaaaaagcacatacattaaaactaggtaatgttttgtatatacagttattttggatatattattgtaagttgtacaaatgtattttgaagaatatttaagaaaagcacttttgttattccatcaataaatgctctatttt

SEQ ID NO: 317544 - DNA, 938 bp, Homo sapiens
ggcgggcgggcgctgcgagccgggttcggccggggcccgggctccggccccgggcggtgtgtggggagcgatctgtgtgtgggggacggcgtggaggggtggccgctgcgtgtgcggtactgtgggggcggcggggccgctgggcgccccttctccgcctcgtaacctcgcctctgtgcttccctgtcgcccgccctgttcctcctcccgtcccgcagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggcgttcatattccgggtggtctccacagaatgcttaacaggtctggagatcctggtggcaaaagtccacatgggggggataaactttggaaaaacagagccaatcttcccggtgaaaatgggcgccaatataagggcttggaaacaactgggaatggcgacacaattttgaccacctcaaaggggcataagacaggcgcacaattggagaaataaaaa

SEQ ID NO: 317545 - DNA, 758 bp, Homo sapiens
actttcacttgttcttttcagatgtaatactgtagatattaaactttttagacttttatattaggaataaccttagtgcagtgactagaaagacattgaaactatgggctttacatcaaggcaaggctgcattttgatctagacaaggctgttttggtatatttttccccacgctctgtcttttcagattgaattactgatttttccccctttgttttgtttgttgtggttttgatgttttttttcctttcagctaaaggagcagcccagtggttttcaagaagtgctaaagtgcactgactgtctcatgatgactggtgcctcagggagggtcatgattcctggatacaggatcgacctgatcctggatgtcacttcaagcagtcagatcgtggggaaaagccttgtctaatggctagccttcctcaaaagtctgatgctagtcatctcggaaggcctcagaaaaagccttaaaggtgagcagagtagagtgtagttctctctgggggctatgactatttgttggagaatctgattcaacatagaatgacaaccctaaactgataaatccaggttcaattggtaattaactttgagcttataaattggttgatgatgattatcagaccccagcttttgagttagtagaaccaccttgctaagcttaagatctgtaagtgaggaactcggtatttcctggggctcttcacagctttaggttagtatctgttgtcttagaccgaaatagccttgctatc

SEQ ID NO: 317546 - DNA, 707 bp, Homo sapiens
ggcgggcgggcgctgcgagccgggttcggccggggcccgggctccggccccgggcggtgtgtggggagcgatctgtgtgtgggggacggcgtggaggggtggccgctgcgtgtgcggtactgtgggggcggcggggccgctgggcgccccttctccgcctcgtaacctcgcctctgtgcttccctgtcgcccgccctgttcctcctcccgtcccgcagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgaggtactggggacacacagatggaattaagcaaggctagaaaacgtattatctttgaagacaggcaagtaaataaacatttgtaatacattaagataaatctcatggcagaaataaacagaaggttctgagacagcgtaaagaaaggagtaaagttttgagggaagagtaagg

SEQ ID NO: 317547 - DNA, 397 bp, Homo sapiens
ccagatgagagcagtttataaagaattggtgatagttacacttaattttctagacagttgctgcaaaaatacccttccagaatgaattcgttagattttgaattgtgaaagtatattttaaattaattcagcaacagttttccttgtgatacatagttactttggctgtgtataagaatagcggcagctccatacgtttatatttagttctatatttatgttctaggtactggggacacacagatggaattaagcaaggctagaaaacgtattatctttgaagacaggcaagtaaataaacatttgtaatacattaagataaatctcatggcagaaataaacagaaggttctgagacagcgtaaagaaaggagtaaagttttgagggaagagtaagg

SEQ ID NO: 317548 - DNA, 3593 bp, Homo sapiens
agctgtttaaatatgctaatgaaaggatagggcctgaccagtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgt

SEQ ID NO: 317549 - DNA, 4130 bp, Homo sapiens
agctgtttaaatatgctaatgaaaggatagggcctgaccagtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgtgtcaatttccctcaggttctattttcttaaaccaacctttaaaattgtcacctctgttaaggttgaactttgccaaaaaaaaaagaagttactttgtaatttttggggaaaaaagcacatacattaaaactaggtaatgttttgtatatacagttattttggatatattattgtaagttgtacaaatgtattttgaagaatatttaagaaaagcacttttgttattccatcaataaatgctctattttactcttgtgtggtttaggaaataatcacatttaaagtaatcatttaaaaacatcctaagataatggaattttaaaggccttgctttttagcattggaaaaatacaccacttgaagttcatgtttgttaagcctaactgtaattacatgttacataatctgcattgcctttttactatatgttcgtagtttttgttggccatgccaacatactcccatttctgcctagattatgggaatgactttgtatggggcagatagacagatactttaaaagctatttaaaaagca

SEQ ID NO: 317550 - DNA, 3848 bp, Homo sapiens
  misc_feature (3842)..(3843): n is a, c, g, or t
  misc_feature (3845)..(3845): n is a, c, g, or t
  misc_feature (3847)..(3848): n is a, c, g, or t
agctgtttaaatatgctaatgaaaggatagggcctgaccagtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaaatgggaaaatcaagacttaaagagtttaagaaacttgcccaagatgacataatgagtatgtgatggacctcgattcaaatcaagcctgtgtgtgtgcagagcccatgctctagtcacctacattttgctacctcccatctcgtgtggcatctcacatatagtaggtgcagaaaagaggctgttgactaattgccttattgacaattaatagagtattttatttaatagagtgtttatactggataaaatatattttcatatttgctgtgtgcactttatgcctttggagcacagtgggaaaagaatggaacttaaagccttggttttcctagtaaaccctttgagcacaaagaatcactacaccaattttatatttccccagggacaaggcatttaaaaatttactgttgaaggatactttaaaagggctgctgatattatttttctttgaaaataaaaaagatcaaaatggaaannanann

SEQ ID NO: 317551 - DNA, 3108 bp, Homo sapiens
ggcgggcgggcgctgcgagccgggttcggccggggcccgggctccggccccgggcggtgtgtggggagcgatctgtgtgtgggggacggcgtggaggggtggccgctgcgtgtgcggtactgtgggggcggcggggccgctgggcgccccttctccgcctcgtaacctcgcctctgtgcttccctgtcgcccgccctgttcctcctcccgtcccgcagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgaggtactggggacacacagatggaattaagcaaggctagaaaacgtattatctttgaagacagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgt

SEQ ID NO: 317552 - DNA, 3101 bp, Homo sapiens
agctgtttaaatatgctaatgaaaggatagggcctgaccagtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccgggacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgt

SEQ ID NO: 317553 - DNA, 3047 bp, Homo sapiens
ggcgggcgggcgctgcgagccgggttcggccggggcccgggctccggccccgggcggtgtgtggggagcgatctgtgtgtgggggacggcgtggaggggtggccgctgcgtgtgcggtactgtgggggcggcggggccgctgggcgccccttctccgcctcgtaacctcgcctctgtgcttccctgtcgcccgccctgttcctcctcccgtcccgcagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgt

SEQ ID NO: 317554 - DNA, 2798 bp, Homo sapiens
ccagatgagagcagtttataaagaattggtgatagttacacttaattttctagacagttgctgcaaaaatacccttccagaatgaattcgttagattttgaattgtgaaagtatattttaaattaattcagcaacagttttccttgtgatacatagttactttggctgtgtataagaatagcggcagctccatacgtttatatttagttctatatttatgttctaggtactggggacacacagatggaattaagcaaggctagaaaacgtattatctttgaagacagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgt

SEQ ID NO: 317555 - DNA, 3004 bp, Homo sapiens
agcgagttaaatatggaggatgaggggaagatatcaagaataacggctaggtttttagaacaggttttgtagcttgggggagaagaaacaaattgtacatattgtgtctgaggaacctgtggaagattcaggttatgtctagtgggtagttagatacagcagagaaataggagccatctggccccaacagtagatttgtgaaccaccagggtataagcagtaactgaggccaatagagtcctttatagctatgacatttaaaattatttcctcatagctcattttgttcacaatttgtgagatttttaggaagaggactattaagaggtagattggggagtaacatgcctttttaaaaaaagtattacttttttatacctctagaacaggggtttctaaaataagggtgtgtatcctatagagtttaccaaaatgattgctggaatagggaaggaaacattagaagttctatttatggttatttttctcctattttcataccattttggtatatattttgttatgtacatctacatttataatttgtataattagaaatatatagtgtgttcaaaaactgatcaagatctatgattactttggaagtcgctactctctataagtaattgctacaaatgaagacttgtgagagtttctatatacatttctaattttttggatgtaaaaattaatgaatactcaattactaaattttgcgtaagacctaaaaatattttcatttctatagattttcaagtgtttatctttttgttgtgaatattacataactttagcattacattttcaagtgtttcctttcagcttaatgttgcttttagcagtaaatcaaactcttactagcaagacggaggaactgagtaaattttgataatgaggaatatttagttttgtttctgaaatttcatgtaagtagtaattacaagactttcccctttagccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgt

SEQ ID NO: 317556 - DNA, 2533 bp, Homo sapiens
ggagtacagagtgggaaggggtatgagggaagaggtcttttagaggttgttacatgccaactcatttttctaaactttgtttgcaatatgcaagggagaaaataagtacttggcatggctgaagtatggagtctgtatggcgtggtggtgggaaggcagatagggaccagatcactgaagatctttatatgtgatattaagtgtctagaccctatttttaggtgattggctgttacttttaccgaacagttttagatagggaaattatatgatcctatttatatttcactgccatggattgatcagacagggactgattagaaactaaacaaagcaaaaagcatttgtactagtctaatctgagaaatgatgaaggcccaaattaaagtggtaagaaatagaagataacatttctagagagatgagagtttagtattgacagaaggcagcaactagtaatgactacctaccatgtttatgtgttctgccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgt

SEQ ID NO: 317557 - DNA, 2373 bp, Homo sapiens
agcgagttaaatatggaggatgaggggaagatatcaagaataacggctaggtttttagaacaggttttgtagcttgggggagaagaaacaaattgtacatattgtgtctgaggaacctgtggaagattcaggttatgtctagtgggtagttagatacagcagagaaataggagccatctggccccaacagtagatttgtgaaccaccagggtataagcagtaactgaggccaatagagtcctttatagctatgacatttaaaattatttcctcatagctcattttgttcacaatttgtgagatttttaggaagaggactattaagagccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgt

SEQ ID NO: 317558 - DNA, 1645 bp, Homo sapiens
agctgtttaaatatgctaatgaaaggatagggcctgaccagtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgaggtactggggacacacagatggaattaagcaaggctagaaaacgtattatctttgaagacagctaaaggagcagcccagtggttttcaagaagtgctaaagtgcactgactgtctcatgatgactggtgcctcagggagggtcatgattcctggatacaggatcgacctgatcctggatgtcacttcaagcagtcagatcgtggggaaaagccttgtctaatggctagccttcctcaaaagtctgatgctagtcatctcggaaggcctcagaaaaagccttaaagaccaatggagaagtaggttttattctttttcttttggtaagaagttgaagatggactcaaaggtgaaggggcagtaaagtctccaagggaagctaggaaaaataggacagtcttcccaaatttaaattgaagttgcatttccttttctgttggctacgaagatgatgacgtaagatatttgggttggcgatattactaaaattaatcatttaaaataacaatatggaaaacctcacttgtattcaagcaaaaaataaactgaatgtaaacaataatttt

SEQ ID NO: 317559 - DNA, 1648 bp, Homo sapiens
agctgtttaaatatgctaatgaaaggatagggcctgaccagtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgaggtactggggacacacagatggaattaagcaaggctagaaaacgtattatctttgaagacagctaaaggagcagcccagtggttttcaagaagtgctaaagtgcactgactgtctcatgatgactggtgcctcagggagggtcatgattcctggatacaggatcgacctgatcctggatgtcacttcaagcagtcagatcgtggggaaaagccttgtctaatggctagccttcctcaaaagtctgatgctagtcatctcggaaggcctcagaaaaagccttaaaggtgagcagagtagagtgtagttctctctgggggctatgactatttgttggagaatctgattcaacatagaatgacaaccctaaactgataaatccaggttcaattggtaattaactttgagcttataaattggttgatgatgattatcagaccccagcttttgagttagtagaaccaccttgctaagcttaagatctgtaagtgaggaactcggtatttcctggggctcttcacagctttaggttagtatctgttgtcttagaccgaaatagccttgctatc

SEQ ID NO: 317560 - DNA, 857 bp, Homo sapiens
agctgtttaaatatgctaatgaaaggatagggcctgaccagtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaaggtaccgactgaccgagcccgggcggcgaccccggcccggcggcccgcgggcggcagggtgggggagggcggccggggcgggggtgtcggggac

SEQ ID NO: 317561 - DNA, 1099 bp, Homo sapiens
ggcgggcgggcgctgcgagccgggttcggccggggcccgggctccggccccgggcggtgtgtggggagcgatctgtgtgtgggggacggcgtggaggggtggccgctgcgtgtgcggtactgtgggggcggcggggccgctgggcgccccttctccgcctcgtaacctcgcctctgtgcttccctgtcgcccgccctgttcctcctcccgtcccgcagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgaggtactggggacacacagatggaattaagcaaggctagaaaacgtattatctttgaagacagctaaaggagcagcccagtggttttcaagaagtgctaaagtgcactgactgtctcatgatgactggtgcctcagggagggtcatgattcctggatacaggatcgacctgatcctggatgtcacttcaagcagtcagatcgtggggaaaagccttgtctaatggctagccttcctcaaaagtctgatgctagtcatctcggaaggcctcagaaaaagccttaaagaccaatggagaagtaggttttattctttttcttttggtaagaagttgaagatggactcaaaggtgaaggggcagtaaagtctccaagggaagctaggaaaaataggacagtcttcccaaatttaaattgaagttgcatttccttttctgttggctacgaagatgatgacgtaagatatttgggttggcgatattactaaaattaatcatttaaaataacaatatggaaaacctcacttgtattcaagcaaaaaataaactgaatgtaaacaataatttt

SEQ ID NO: 317562 - DNA, 194 bp, Homo sapiens
acctacaactcaagcacagccagatcttattaaacctcttcctcttcataaaagtaagaattgtttttttcttaaacattatttgctgccttttggttccttttcaaggaagatatttttgttatagattatagaaggaaattgattagtagtacaatgagtgaatgaatgtatagaaaatttgtttaaatgag

SEQ ID NO: 317563 - DNA, 364 bp, Homo sapiens
ttgacttctatgtgtgaaaataatgagtagtgatagtttgttcacattatacgtttctagatgacttgtttaaagtgcataaagcaaaaccaacattgaagtggagacagtcatttgaaagttatttgaagacaatgcctccctactatcttggggtaagaatattatttaaaagaacttgttggccgggcgcagtgactcacgcctgtaatcccagcactttgggaggccgaggcgggtggatcatgaggtcaggagatcaagaccagcctggccaacatggtgaaaccccgtttctactaaaaatacaaaaattagctgggcgtggtggcgggcgcctgtaatcccagctactcgggaggct

SEQ ID NO: 317564 - DNA, 614 bp, Homo sapiens
ggcctctaatcctttttaactacttcaaacggcctttcatcccactgacaaacattttactgaaacataaatacgattgtgttacttccttattgaggaaaagaaggggaaataattttttggagaaaattttaagacagactatacatggaaccataagtttttaataagcttaatattgaatgatgttttcttttttcctatagcccttgaagaaagctgttaggatgatgggagcacctaacctaatagcagacagtatggaatatggacttagttacagtgtcatttcatacctcaaaaaactgagtcaacaggtaatatcaagaaatagagtgagccattaagtattttgaatggttttggctaggatggttaaacaggttaaaagctagttcttgatggttctaatggaattccattatattaatatattacattttagagccatatattacataattctgtctcacatccatggtgtgctatgttttgaaacattaatttgaaaattatataataattcctaatttatgaaaatggcttcatgagtgtggtcctagacttgctatatgtgaacattatttatcttttgagaaatttagattagaaag

SEQ ID NO: 317565 - DNA, 7267 bp, Homo sapiens
ggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgcagtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacaggccattctttgccccatacctttacacgccaaggtattaccctggcggctcccaacatctcatctcacgtccatcagtaaaaacgagtttgcccagagatcagaacaatggcctagaagttatcaaggaggatgctgctgaggggctttcttcacccacagactcctcgagggggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacccttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgcta

SEQ ID NO: 317566 - DNA, 3755 bp, Homo sapiens
ggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgcagtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagatgctgtggagcagacagttgtgaccgagaccgaattggcatttccaagtcagtgttagttgccatgttgatggagagctgagaaaagccattttaatggcatttgcaaataagcaggacatggaacaggccatgactccctcagagatgcacattcacttgggttatctgcctcgaaggactgaaaatggcaaatattcaaaacttcagcaaccagaggtactggccttcatgagacaacggaatgggtagttgaaacattaaagagcaaacaacagtacagtcacttctgctcctctgaaatgaagacggcctcacatatccctttggaaacaatcaagtgtgcttctcatgactaaaggttaaagctgtaagactgttggcatttactgaactgactgtgacattagtaataaatataaaaaatagatatttagttgaaagggtaattcatcttgattgagccaattgtgttctatgttgtaggacatgctgcttccctgctttcttaatgttaagtacacattccatttgtatgggatttttattcaaatagtcctattaaagtatgcacttttgttggg

SEQ ID NO: 317567 - DNA, 1297 bp, Homo sapiens
gttttaagaaacaacctattactaacataaaatgtatttattttcatttctggtaaatatctatggaaggaaaatgactagcagtctcagcgaagaaatgttgacttgtttatagccagaaatttctggcttgtaatatagtgtttgctaccaaaacttttaaaactaagcctttacatttggtaatttctaatatcttcttaaagaacatgtgtatacagtacctttatagtatgtaaatattagcaccatgatataaaaaatagaggatgtattgaaggaagaacatttcaatcaaatggcaggaattaaacaagataagggaaattcttccaatgaactattgaatctaataaagacatttgtgcccaaaatattagaggttcctgatgataaaagtaatagtttaaaaaaagaaactctctattaatatgtttttataaatcaggaggcaaaaacataaactgttgagtttcagtgttgtatattattttaccatcatgttcatttgtcttcacagtttggctccccccttccccttttcacccacactctcctgttttgtgttgttaggaagttatcaaggaggatgctgctgaggggctttcttcacccacagactcctcgagggtaatggagtagtcctgtggtgtggatcgctggcatctcattgcttctgcctcagtaatgactgtcttaattgtgatgatagcagctcactaactctgcgttgtggtgtgatgagcagctagtgtagagtagctgaatgctaataattatggttcctgaattaattaaaaagcggatgtttaacttcacccattatttcctcctgcttttcccctttttcaatacatgggatggggtttattattattcttcaataaggaagggctttttctatcagctgtcaggggtgttccgttggtagtatttgctcctcagtgtgagctctagctttgcctttgactgtttttgttaagcctgtggttgctattacacatgtggaatattttagaaaagtatccagtatcacccttgagactacaaaaagacacataagctagatggtgtagactaaaaatgcatctttaataactcaatctaggtgtctacatttagttaagtcttagtctgagttttagtgcagtgttataatacttttctttgtctatatatttgttaaaataaattttccagataaacagaagatcgttcagcatgtaaaagaaattatttatttatttatttattttttgccaacaccttaaggtaggtttctttaaaaaaaaaaaac

SEQ ID NO: 317568 - DNA, 424 bp, Homo sapiens
tggttttgaccaggctgtatcagctgtaataaaagctactcattaggttataacagtaactaaatctgttccctaatggtatttccttaccatgctaaacatatttgtttttttttactttacttcatggtataacttaatgagtttttctctgtcacatgacctcattatagatggcattaaatgcttattcatacctgtatttttccttgacttctctaggggtcaggcccagccccaggcccagtggtattactgaattcactgaatgtggatgcagtatgtgagaagctgaaacaaatagaagggctggaccagagtatgctgcctcagtattgtaccacgatcaaaaaggcgaccagggagcccagggaccaccaggtcctccacttgatctagcttacctgagactgcctcgccaaat

SEQ ID NO: 317569 - DNA, 7210 bp, Homo sapiens
ggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgcagtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacaggccattctttgccccatacctttacacgccaaggtattaccctggcggctcccaacatctcatctcacgtccatcagtaaaaacgagtttgcccagagatcagaacaatggcctagggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacccttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgcta

SEQ ID NO: 317570 - DNA, 6281 bp, Homo sapiens
gatactaatgaagtggacccatggcctaggaggagctgcagggagaaagcctgttgcttctcctctttcactgagttaagaaaaggggaaaagaatgaccttcattctagagggctgtgggagaaacagtatctgagcaaagctggatgaggagctacagaaggatattatggggaagatagagataaaaattcatattatatatgtgctttatatgaaaaataagaaaagttcagattttgttattttacagaaacatgaaaattgttactgtctgcatactatatataaagataagaaagttcaagtttcgtactattattttacagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacaggccattctttgccccatacctttacacgccaaggtattaccctggcggctcccaacatctcatctcacgtccatcagtaaaaacgagtttgcccagagatcagaacaatggcctagggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacccttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgcta

SEQ ID NO: 317571 - DNA, 4152 bp, Homo sapiens
gttttaagaaacaacctattactaacataaaatgtatttattttcatttctggtaaatatctatggaaggaaaatgactagcagtctcagcgaagaaatgttgacttgtttatagccagaaatttctggcttgtaatatagtgtttgctaccaaaacttttaaaactaagcctttacatttggtaatttctaatatcttcttaaagaacatgtgtatacagtacctttatagtatgtaaatattagcaccatgatataaaaaatagaggatgtattgaaggaagaacatttcaatcaaatggcaggaattaaacaagataagggaaattcttccaatgaactattgaatctaataaagacatttgtgcccaaaatattagaggttcctgatgataaaagtaatagtttaaaaaaagaaactctctattaatatgtttttataaatcaggaggcaaaaacataaactgttgagtttcagtgttgtatattattttaccatcatgttcatttgtcttcacagtttggctccccccttccccttttcacccacactctcctgttttgtgttgttaggaagttatcaaggaggatgctgctgaggggctttcttcacccacagactcctcgagggggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacccttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgcta

SEQ ID NO: 317572 - DNA, 7705 bp, Homo sapiens
  misc_feature (7705)..(7705): n is a, c, g, or t
ggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgcagtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacaggccattctttgccccatacctttacacgccaaggtattaccctggcggctcccaacatctcatctcacgtccatcagtaaaaacgagtttgcccagagatcagaacaatggcctagggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacccttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgctattctgactcatgaatttttattcactatgatgattcacattttgattaaaaataaaagtagtttgtgtgtttaaaaaaaaaaaaaaaaaaaaaaaaaaaaaaaaaaaaaaaaaaaaagggcgggccaccacaaaaaatcacccacggggaggcgcaaatgtcttgaccgcacccccggctttcttggtacaaaagaggggcccccaaacgcgggagacgtatacttaacacgccagacgcgcggcgcgcgcgttattaacaaacaccgtacgcagggggaaaaacccgtgcgacagcgagcagacccgttgttagaagagaacccctcaactttgcggggggtggggaccacaatactgtgggcacccccaccactcaggcagtttaacccctacaagcgaaaaactacgacctaaccgcctacaccgggacccaaccggaatatcagggtgtaaagactgcgccaaaggcatcgtccaaacaaattaccggggn

SEQ ID NO: 317573 - DNA, 4412 bp, Homo sapiens
ggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgcagtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacaggccattctttgccccatacctttacacgccaaggtattaccctggcggctcccaacatctcatctcacgtccatcagtaaaaacgagtttgcccagagatcagaacaatggcctagaagttatcaaggaggatgctgctgaggggctttcttcacccacagactcctcgagggtaatggagtagtcctgtggtgtggatcgctggcatctcattgcttctgcctcagtaatgactgtcttaattgtgatgatagcagctcactaactctgcgttgtggtgtgatgagcagctagtgtagagtagctgaatgctaataattatggttcctgaattaattaaaaagcggatgtttaacttcacccattatttcctcctgcttttcccctttttcaatacatgggatggggtttattattattcttcaataaggaagggctttttctatcagctgtcaggggtgttccgttggtagtatttgctcctcagtgtgagctctagctttgcctttgactgtttttgttaagcctgtggttgctattacacatgtggaatattttagaaaagtatccagtatcacccttgagactacaaaaagacacataagctagatggtgtagactaaaaatgcatctttaataactcaatctaggtgtctacatttagttaagtcttagtctgagttttagtgcagtgttataatacttttctttgtctatatatttgttaaaataaattttccagataaacagaagatcgttcagcatgtaaaagaaattatttatttatttatttattttttgccaacaccttaaggtaggtttctttaaaaaaaaaaaac

SEQ ID NO: 317574 - DNA, 3532 bp, Homo sapiens
ggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgcagtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcagtgaaatgtgaatggacgagcgatcatctttttttt

SEQ ID NO: 317575 - DNA, 3420 bp, Homo sapiens
ggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgcagtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcaggtgggtattagtagtaaatttaatttttcatctaaagttctaagaatttttcatgtttctaacttatttg

SEQ ID NO: 317576 - DNA, 565 bp, Homo sapiens
tccattgtgggtgaatggatgttctgctcaatgatcgtgggtggcgttgaactgtgtgacacagttctgaaagatgtttgcctgcatatacgtggtcgaagaagtatatctcaccagtggcaaatcaaacaaccaaaaaattgctttagaattaaaattgtgtttaagccctaaaagctttacttaatgcagctctttggattttagaagccatggcagtactagatttgaatttgtagtataaattaaatggtaaattttagaaatttaaaatatttgtgaatatactaaatgttttacttaacatgctatcacacatctattaattttaaaatgcttttgtattttttaaaaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaaggtaccttttgtgacctctttgtattttactttattttaggttgagtt

SEQ ID NO: 317577 - DNA, 598 bp, Homo sapiens
atcggcgtaccaagagtcccccactcctgctgcctccccttagtaatgttccatccacgacccccaccctgccccttggtggtagatccccactcattcgtgcttattccgagttggactcccttctgtagtgagactgcttacccctgttgccatagttctgaataaaatctggacctaccgccctactcctggccagctctggttttgacacaagccagctgcatttttctttgtcctcaagttaagttttaaacagaagtaataatttaatggacaaattgcagtgtagtatatgtatggtggtttctaccattgcttcctttagtattaatgaacatgaaagataagctgatgtataaaacaaattcactagaaattcacttaccagaagtatgctttctcattgctgttgcaatagctttataatgtttggtatttctaaatatttctaaagcttctaaaatatgatttgttagtgtaaatatttatgtttttcttctgttaaggtactagaaatgagaaacgcagaaagccacgtggtccctgaagacccacgtttcctcagtgagagcagcagtggcccagccccgcacgg

SEQ ID NO: 317578 - DNA, 214 bp, Homo sapiens
aagagtttcacagaacagccttggggagatgacaaaacttggtagcaagacagccctcaatagacgggtaagatgccattggcttcgagctgtatgtttgtattgctattcaatttaatacaaataaagatgatgccacttaaataatactttgtaaatattgcattaaacgcttcaaataaacattatcattgaatttcctttcagcttcatg

SEQ ID NO: 317579 - DNA, 350 bp, Homo sapiens
gaaatgaccaatataaaaatgtaagtaatatttcttaagtttgagtttagcatcttatggaatatgagtgaggcttttttttcttttgttttgtcatttgcattaaagttttggagttgtatcttattggtttcatttgaaaaatctcattacactttcatttctgtaattgtttaccccttttttgttacatgtttttccatagccattctttgccccatacctttacacgccaaggtattaccctggcggctcccaacatctcatctcacgtccatcagtaaaaacgagtttgcccagagatcagaacaatggcctagtaagtatataaaagggtaacgcaaatatta

SEQ ID NO: 317580 - DNA, 356 bp, Homo sapiens
tgatgataaaagtaatagtttaaaaaaagaaactctctattaatatgtttttataaatcaggaggcaaaaacataaactgttgagtttcagtgttgtatattattttaccatcatgttcatttgtcttcacagtttggctccccccttccccttttcacccacactctcctgttttgtgttgttaggaagttatcaaggaggatgctgctgaggggctttcttcacccacagactcctcgagggtaatggagtagtcctgtggtgtggatcgctggcatctcattgcttctgcctcagtaatgactgtcttaattgtgatgatagcagctcactaactctgcgttgtggtgtgatg

SEQ ID NO: 317581 - DNA, 431 bp, Homo sapiens
  misc_feature (18)..(18): n is a, c, g, or t
  misc_feature (20)..(20): n is a, c, g, or t
ggagagagagagagagananagagagagagagagccattgttctttgacacacaacgccactgtcgagtgtggctctccatgatttgcttcaggaaggctacaggcagcgcctcttccagcagtcctctcctttgaccatggaagtggccacagaaactcttactttttcctcaagtctgaaatatctcttagactgtgacataggaacacatccctacacctcagttttcttatttgtataacgagaccataaaactaactaattcataaaatttactgtgagagttaaatgagagatagcatgtggaattggacctcagctcactctgacgacagagtcttatcttctttttgtacctggggcagacagccagttggatggcctcaggagctgttattttttcaggctgccattgatttttagatttaa

SEQ ID NO: 317582 - DNA, 932 bp, Homo sapiens
ggttccaacatccattctacataaatttctaacaactatgtatagaggattttttttttcttaaaatgataaatatcaaatatacaaaatgaaaaatcaagattcttattaaagaaaaagtaaccatcagcctttgcctttaaaagagattatagataaagcaagaatatgaccctttttgcagttcaaatgcacagtatctacttgaggggaaaaagagaagctcagatatggcaaagtgcaccattttttataattacttggctacacatacaaggggaaaaagggacaagtaaacatactaacaatattgtaaaagctccacaaaaagggaaaatcaactgcagaacaacttacatgtggcacattattcatataaaataaatccactcacatggtaattttttaaattattaaatgctcagacacaaattttcctcagaacacaacatttatgcaaaggaatatatagaatgggtacggtagctcatgcctgtaatcccagcactttgggaggccaaggtgggtggatcacctgaggtcaggagttcgagaccagcctggccaacatggcgaaaccctgtctctactaaaaatacaaaaattaaccagccatggtggcaagcacctgtaatcccagctacttgggaagctgaggcaggagaatcacttgaacctgggagacagaagctgcagtgagctgagatcgcgccactgcactctagtgtgggtgacagagcgagactctgtctcaaaaaaaaaaaaaaaaagtataaagcccaattaaatggatgaagaaaagaaaacatgaattctagttaacaaaattaaacatagtaatgacaacaaaaataccaaaaagactgggaaactataagagctaagaccaacattctaaatatctagagaaaggaagatttttgtattagtaa

SEQ ID NO: 317583 - DNA, 504 bp, Homo sapiens
cctgtttcttaaggtagaaattactacaagggaccaagagcaatgttgtcacagggaaggataaattaggacattcacctggagtcttttaccttagggggggatcctacagtcatcctgggatgggtgggtggacctacaatgaagtgactccaactagcaccaagatggtcctgcctacctttccttttccacatttcttctctctactgcctcccatcttagttcattctgtgctgctgtaacagaatacctgagactggctattttaaaaggaatagaaatttatttctcacagttctggaggctgggaagtccaagatcaaggtgccagcatctggtgagggctgctttctgcctccaagatggcacctcgaatgctgcatcctcctatggcagaaggtggatgggcaaagagtgatgaactcccttcatcaaacccctttataaggacacctaaggaaggagccctcatagcctgatcacttcttagaggccatcttt

SEQ ID NO: 317584 - DNA, 1411 bp, Homo sapiens
agcgtgggcgcctggcaagtgaacaatcgcggtgagaggggcgcgccgcagctcctcaacgccgcaacgcgccggcccaactgcaggaaggtctgtgctctggagccaggtaaatggttataaaattatacaccatggccctcctaaagacactctaggaaaaccatgtcatcctgatcttaaaacacctgcaagaaagagcacagtacttcaccattaataaagtagatatttcatcctgctcagaaaaccaacatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgc

SEQ ID NO: 317585 - DNA, 1386 bp, Homo sapiens
agcgtgggcgcctggcaagtgaacaatcgcggtgagaggggcgcgccgcagctcctcaacgccgcaacgcgccggcccaactgcaggaagggttataaaattatacaccatggccctcctaaagacactctaggaaaaccatgtcatcctgatcttaaaacacctgcaagaaagagcacagtacttcaccattaataaagtagatatttcatcctgctcagaaaaccaacatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgc

SEQ ID NO: 317586 - DNA, 802 bp, Homo sapiens
agcgtgggcgcctggcaagtgaacaatcgcggtgagaggggcgcgccgcagctcctcaacgccgcaacgcgccggcccaactgcaggaaggtctgtgctctggagccaggtaaatggttataaaattatacaccatggccctcctaaagacactctaggaaaaccatgtcatcctgatcttaaaacacctgcaagaaagagcacagtacttcaccattatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgcaatgaaaacatatctcaataaaagggaggggataaacgtttggaaatgttttttaaggt

SEQ ID NO: 317587 - DNA, 1374 bp, Homo sapiens
agcgtgggcgcctggcaagtgaacaatcgcggtgagaggggcgcgccgcagctcctcaacgccgcaacgcgccggcccaactgcaggaaggtctgtgctctggagccaggtaaatggttataaaattatacaccatggccctcctaaagacactctaggaaaaccatgtcatcctgatcttaaaacacctgcaagaaagagcacagtacttcaccattatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgc

SEQ ID NO: 317588 - DNA, 1349 bp, Homo sapiens
agcgtgggcgcctggcaagtgaacaatcgcggtgagaggggcgcgccgcagctcctcaacgccgcaacgcgccggcccaactgcaggaagggttataaaattatacaccatggccctcctaaagacactctaggaaaaccatgtcatcctgatcttaaaacacctgcaagaaagagcacagtacttcaccattatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgc

SEQ ID NO: 317589 - DNA, 1860 bp, Homo sapiens
gtgtctttttaggagataatgaaaatacgaaacaatcttcttaccaaataatggattgagtaaacttgaataagctatatcttcaatgcattaattgtattttttgtatacagagaaatttgaaaatattcacaagtataaggaagaaaataaacataacttctagttactccattagggaaataacagctaataaagtatttgcacaaccatatctgtgtaatcacaaccttgtcatcttaattagagtctggtataaataaaaggacaaaccgttttacttttcgtatagaatagccaattgagagatggtacatattgaaaataaactttcctccaaaaattgagatgaagaatgaatgtcagtactataattaactattaaggaatctattttctttttgatggcgtaagggtaacagaagtaggcagaaagaagggagtaggtctctctcttttatagatgtacctcaagggcatcagtagagttcttcagctttttctttattgtcactatcaaagacaaggttggcctcattatgattctactagtaccatagggcaattcttcttttgttccattgttaatgaatctgggaatcacagttcctttgagataatcgagatcattatattggtattccccctcttagaagttttttaaactacatatttcaatgcagacctttgtttttcttgacttagtttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgc

SEQ ID NO: 317590 - DNA, 1455 bp, Homo sapiens
agcgtgggcgcctggcaagtgaacaatcgcggtgagaggggcgcgccgcagctcctcaacgccgcaacgcgccggcccaactgcaggaaggtctgtgctctggagccaggtaaatatgtaagacccggattggagactagaaatggctagggacggggaggtggggtgaagcacaggggagagaaccatcgttgagggttataaaattatacaccatggccctcctaaagacactctaggaaaaccatgtcatcctgatcttaaaacacctgcaagaaagagcacagtacttcaccattatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgc

SEQ ID NO: 317591 - DNA, 1793 bp, Homo sapiens
ctattatagtgctgagaatgaattgttcggcactagaaagaaagaacaaataggtcataagcgaattcactccttttcgctttgaaaacaactgtgaatagaagaaaatgcacctattactcatccgccttctgagagagaaaacatgtctttaacccatgcttgatacgtatgctaaacttgcagccagtagccttgggtcaggagttctgcgtattttcataagagttgttcctgttactcttcgtgaattttctcaccataaaactgttgccaacggggaagagggacaagaacatgaagtgtttatgagggagcctgaaactgacaacctgtgtaactggagtgcgtcgttggcatgacactggcagcgcactgcaaacttaagcacctgtggactcctaattagctctttaaattgaactacattaattcaggcattcttgtttgaatgcgaacgcctcctttttcaagccaccccctgggcaacccgaatccttatatgacctccctcctcctcctagtacggcgcagggttataaaattatacaccatggccctcctaaagacactctaggaaaaccatgtcatcctgatcttaaaacacctgcaagaaagagcacagtacttcaccattatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgc

SEQ ID NO: 317592 - DNA, 1093 bp, Homo sapiens
agcgtgggcgcctggcaagtgaacaatcgcggtgagaggggcgcgccgcagctcctcaacgccgcaacgcgccggcccaactgcaggaaggtctgtgctctggagccaggtaaatggttataaaattatacaccatggccctcctaaagacactctaggaaaaccatgtcatcctgatcttaaaacacctgcaagaaagagcacagtacttcaccattatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcagttccacataccaacaaaactagtgatgccagctgctctgaacgacctagcaagaaactgactcatggaggaatgcagtttcaacatcctgatgattacatcccccttaccctgaccaatcaacaatccaaatttttcagcttctcatcctccacagtctccttaaaggaccccttcatggagcaaatttgtggcttgagatttcctctcatttcctagttcaaaggccttgtgattattaaactcattctcggctgtaaa

SEQ ID NO: 317593 - DNA, 1492 bp, Homo sapiens
agcgtgggcgcctggcaagtgaacaatcgcggtgagaggggcgcgccgcagctcctcaacgccgcaacgcgccggcccaactgcaggaaggtctgtgctctggagccaggtaaatatgtaagacccggattggagactagaaatggctagggacggggaggtggggtgaagcacaggggagagaaccatcgttgagggttataaaattatacaccatggccctcctaaagacactctaggaaaaccatgtcatcctgatcttaaaacacctgcaagaaagagcacagtacttcaccattaataaagtagatatttcatcctgctcagaaaaccaacatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgc

SEQ ID NO: 317594 - DNA, 1738 bp, Homo sapiens
gtgtctttttaggagataatgaaaatacgaaacaatcttcttaccaaataatggattgagtaaacttgaataagctatatcttcaatgcattaattgtattttttgtatacagagaaatttgaaaatattcacaagtataaggaagaaaataaacataacttctagttactccattagggaaataacagctaataaagtatttgcacaaccatatctgtgtaatcacaaccttgtcatcttaattagagtctggtataaataaaaggacaaaccgttttacttttcgtatagaatagccaattgagagatggtacatattgaaaataaactttcctccaaaaattgagatgaagaatgaatgtcagtactataattaactattaaggaatctattttctttttgatggcgtaagggtaacagaagtaggcagaaagaagggagtaggtctctctcttttatagatgtacctcaagggcatcagtagagttcttcagctttttctttattgtcactatcaaagacaaggttggcctcattatgattctactagtaccatagggcaattcttcttttgttccattgttaatgaatctgggaatcacagttcctttgagataatcgagatcattatattggtattccccctcttagaagttttttaaactacatatttcaatgcagacctttgtttttcttgacttagtttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaattggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgc

SEQ ID NO: 317595 - DNA, 1289 bp, Homo sapiens
agcgtgggcgcctggcaagtgaacaatcgcggtgagaggggcgcgccgcagctcctcaacgccgcaacgcgccggcccaactgcaggaaggtctgtgctctggagccaggtaaatggttataaaattatacaccatggccctcctaaagacactctaggaaaaccatgtcatcctgatcttaaaacacctgcaagaaagagcacagtacttcaccattaataaagtagatatttcatcctgctcagaaaaccaacatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaattggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgc

SEQ ID NO: 317596 - DNA, 1839 bp, Homo sapiens
aaggaatcaaacttgactagtaaagccaataaaggccccttcagaaaactggcctcataccttgtctacacagtccctctacagggttcttcacctttggtcataagcgaattcactccttttcgctttgaaaacaactgtgaatagaagaaaatgcacctattactcatccgccttctgagagagaaaacatgtctttaacccatgcttgatacgtatgctaaacttgcagccagtagccttgggtcaggagttctgcgtattttcataagagttgttcctgttactcttcgtgaattttctcaccataaaactgttgccaacggggaagagggacaagaacatgaagtgtttatgagggagcctgaaactgacaacctgtgtaactggagtgcgtcgttggcatgacactggcagcgcactgcaaacttaagcacctgtggactcctaattagctctttaaattgaactacattaattcaggcattcttgtttgaatgcgaacgcctcctttttcaagccaccccctgggcaacccgaatccttatatgacctccctcctcctcctagtacggcgcagggttataaaattatacaccatggccctcctaaagacactctaggaaaaccatgtcatcctgatcttaaaacacctgcaagaaagagcacagtacttcaccattatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgc

SEQ ID NO: 317597 - DNA, 908 bp, Homo sapiens
gtgaaagcaatttcagaataaaaagtgtcacctagcaagaaagacttgcgttctgcgcatgtgcccccctcccccatattccagcttgcctgcaaggctggtagttctaaccaacagtaaaagaaaaacgaactgactaaaatccatactctgattgttcagcaagagacattgctaaatttcctgtccaccatttgtacttttatgtattttagggctacctagagagttcttaaaggcccagatgatgaaaatcggctgcccttcttcccaaatgagttgcacagtccatctggagagggcactcacacttttgtatgaagctgtaggccataaaatggaaagtaaagaattaaaaactgcagccatttggtagcagttataaaaaaaaaaaaataggacgggggaaggtagaaggttgtgtggtgggggcagttgctccagcaaattagatttacagaatgggttatagagtaagcctttattgaaagttccttttcacatctctgcaagatatttttttgcttacatttttttctggcctattgcctatcctttgctcctgaccgttcctcttcatgtctccacacccgtgtcactgcccccccaccccatgcattttcctggaaagtctgataattcttgagctcccaatggatctcacttcttaaggttctggttccttttcccttcaagttccctccaaaacaagcattctcagacaattctgattatagaaggaggaagaacaactgtgccggaaccaactggaaaatttggaaagctgacagctagctgcagctgtgctgtactatgttgtataactaatgcactaagattaaatgatttttgtacatcaataaacaatgtggctcatggtatgtcaacaaataaattgagtaacaaag

SEQ ID NO: 317598 - DNA, 387 bp, Homo sapiens
aacaaagactgacaatgcccaatgccagatggagacagagaggtaaagacacaacttctgccatctcagaacttacattctagctagctggggctttgagaggtgcccactcacagtagggaagaattcagcactgggaagattttcctgtcttattttggcaaatcttaggtgagccactgtattcatctgctgagactgccgtaacaaagaaccacagactgggtggccgaagcaacaggaatgtacttcctcacagtcctggaggcacagtccaaggtcaaggtgctgccagcattggtttcctctggggccttcctccttcgttcacagatggcagtgttctggatgcctcttctcgtgattgtccagttgtacacatgtctg

SEQ ID NO: 317599 - DNA, 739 bp, Homo sapiens
ctttccccctatcctttctggcttaaagtttcatttcttggagaatttgtaggagaaatagaaaaatcatgttggacttaagtgtcactatgtgaattttcagccgtagccatgaataaatcttattaaaaagtactactgagtagtattcttaagagatttttagacacaggtaggagaaagaaatcaaaattgtctgtttcacagtgcattattttacttgcaggctttcttgtaattttcttatcagatcgacatttaaagtagctatatttggtcacagtagaagttttgctggttatttaagtgcagtgtcactatggaggtagttgaatgaagtcaataaaagtactgcttacatagcattgatgaaagttcctctttacactttacatatgtaagcaagcatggtaaacagtggcttacgtatccttccagaaattttctgtacctctataagcctgtgtgtgtgtacatgtgtcccaattctaccagtaggattatacaatcactactgttctacaactttatttttttcatttgagggtaaatcttgagtgtctttctgtatcaccacatataaatctctcattttttaaaaactctcataactgaactaccatttgtcagcttctgattctgttagttgaggtctgtggtagcaaataacagaaaccaactctggttaatgtaaacagaagatttgattggaaatattggatggttcacagacaggaaa

SEQ ID NO: 317600 - DNA, 1003 bp, Homo sapiens
gctttcaggatctcagctccaacaccaaggcctctgtgttccctagagaagccactccggatggtctctctgaagtctgcctccttccctggccagctctacaacttagaatgcctgaatatatacaaatatgaacaagacccacaaggactgctcatcaccccagtattccatttacaacatcctgaatgaactcccgaccaggcctataattctctcttgcagccaaatatcctgcttactcctggtatctacctggtcagcagacctcatgagttatcgcccagtgacaaaaccatcccaaagatgcaccagtccagcacaaagtatgactgtcaatctcacaaaagatgtagggttctacgaggatactcagagtataagaattacgctaagtgaaataagccaagcccagaaagacacatactttattatttcatgtatctgtggaatctaaaagagtcaaattcatggcagcagggagagggctgaagaagggggagatgttgatcaaagtttctatgtatacaaagaccaaaccatcacattatgcctcataaatatatacaattattatttgctaattacaagtaaagcaatacaagaagaaaaaaaggaatcataagtaaatccatgacaagtgaaaacgcaatggagagaagggaatcaatgattgaagaagagaaaggacagtggatttacaactgcttcgaaagagtgatttgactggcaaaggactggggagaggtcctttgggaaatggacaaagccctcgaatggttaggaaagacaatctctttataaatgcagggcataagctgagcacaaggtgaagtttggcatgtactgccgtgggatgttgtaaaaattatgtcaaaagcaaagcaattcttggttcatctgtgttcactgtgagactagcctattattggggttaaacttataaacaaacttctattcatcatttttttctccaaaataaagtgatcaaattgtcccacag

SEQ ID NO: 317601 - DNA, 684 bp, Homo sapiens
agctaggctgctgccccctctcatttacacaagtaggaagaggaaagagaacctggaggaggtatggcacacatggcctctgcttacatatcagagaactcagtgtcctggccacagtcaaatacaatagaggccaggaaaggttgtgtatctcggctaacacatgtccagctacaagtttctattacagctgatgaaagagacaactagcgggctctgtacattgattcaatcctgtctgaggatgaccatatagaagcataaggagaggagacaagtgagtcagatagtggccaagtttctgatttgggataccattcacaaagatggggagaagaaaaagtagaagacatttggaagaagaaaaaacattgcaattggacaagttgactttgagattcctatgagcaggggtatactgacaaacctgctctcccagaaaacaaaaacaaaaatcctgtttatagcctttgatgacttccacgatctaaatgtacccatcatggcctatttcaagctaccaagatgatgtcactgaatgagcagttggaaagaaatgtgcatgaataggctttcataagccagcaaaggctgggttcagctcacctctaccagtgaggatttccaaatggaggcatcttaaagacactgggatatgcagagctcaagctaaggagtagaatc

SEQ ID NO: 317602 - DNA, 1271 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctca

SEQ ID NO: 317603 - DNA, 1327 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctcacatgttatggttttgaggatttgctaagaaagtaaatgtttattacggatcttgct

SEQ ID NO: 317604 - DNA, 1140 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacagaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctcacatgttatggttttgaggatttgctaagaaagtaaatgtttattacggatcttgct

SEQ ID NO: 317605 - DNA, 1559 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggtgattaagtaccccctctctcatgcgggacggaggctagggcagggggaaggcacgtgcgggatctggatcaggtagatgttacccgaaaacagccccgttggcctctctgagcctcggtgccctccgctgtagaatgggaccggtcgtacctgaattttcgaggtcagcccagacattgtgaggcatttgtcagaggccgcaggatttgggaagaggcgtccggagataggaatgggtggcacctcgggatggaatgactcccattgcttctccctccttgtccaggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctca

SEQ ID NO: 317606 - DNA, 1849 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacaggtaggtctggcaccctagccagcctttaaaactgcacttgatttgggaggctgaggcaggtggatcacgaggtcaggagttcaagaccagtctggccaagatggtgaaaccctgtttcaactaaaaactacaaaaattagctgggcacggtggcaggcgcctgtaaaaccagctactcgggaggctgaggcaggagaatcgcttgaacctgggaggcagaagttgcaatgagccaagatcataccattgcactccagcctgggagacagagtgaaacgctggctaaaaaaaaaaaaaactgcacttggcttagggaggcaaggagctggggagacagtggtatcagcagcagcctggggagcatttgatggcccccagaggtgtatgtgaccaggcccagctagaggaggcagcttcaggctagcaccccaacaggaaagaacagtccttaggcccggtggcttcagcaattaaatcagggttgcatctcatcatgagtggatcccacagccaggcagattgatagctgtgatcgtcctgacgtgttatgtgtccctctctggatgcaggggccatagtactgacctcactgaaacatatgatctgagaaagggggtggtgtttccccaaaggaaaaggggaggagtgatactgggtggcacagaacgagtagctgcccactgtctctcctggctttcctgttgcccagtgttctccagtcaactacaggtgcacatggtactacagctctgccctgtgcttggggaccacatgtactctgcccgtgtgggcactgtcctgggccagcgatttctgctgccagctgagaacaacaagccccaaagacagaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctcacatgttatggttttgaggatttgctaagaaagtaaatgtttattacggatcttgct

SEQ ID NO: 317607 - DNA, 1225 bp, Homo sapiens
gacgtggtttcaccgtgttagccaggatggtctcgatctcctgacttcgaggggccacaggactagtagagccaagagttgagggtccgggtggggtgatccggccgtcagaaatgcaaaagcctggaaagacatctccaaaggccaatctcaggttggacaatcgtgagctggggaagctgcaaacactgtgacctccggaataaccgctggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaagaggatcacttgagcccaggagttcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggctgagatgggagaatcacctgagctcagaagatggcagctgcaataagctgagatcccgccactgtacgcaagcctaaacaacctgaatgagaccccgtctcaaaaaaacaaaacaaaacaaataccctccctgagcttcagttcccctaatggtaaaatagagaaaataatacctaaaaaa

SEQ ID NO: 317608 - DNA, 983 bp, Homo sapiens
  misc_feature (815)..(815): n is a, c, g, or t
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctcancaaaaaaaaaaagggggggtcaaaaatctgagggccaattagggtaccgtttgtaaagggctaaaggagggtaaagaaggaggggggttaaagtggagggaaaggttggttggggacctcgggggaatggcacgataagggaaaaaggtggaagttgggaggtgatag

SEQ ID NO: 317609 - DNA, 1330 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggtgattaagtaccccctctctcatgcgggacggaggctagggcagggggaaggcacgtgcgggatctggatcaggtagatgttacccgaaaacagccccgttggcctctctgagcctcggtgccctccgctgtagaatgggaccggtcgtacctgaattttcgaggacctctagtgacgttgaacaagccacagggtctaccagtgacaggtatgggccggggatgtgggaagggaatgcagcggaagggggtttcgtgactgagggagggaaaagtgaaggcatgaagctttggcctcttgtaatttttctttcttactttccaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaagaggatcacttgagcccaggagttcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggctgagatgggagaatcacctgagctcagaagatggcagctgcaataagctgagatcccgccactgtacgcaagcctaaacaacctgaatgagaccccgtctcaaaaaaacaaaacaaaacaaataccctccctgagcttcagttcccctaatggtaaaatagagaaaataatacctaaaaaa

SEQ ID NO: 317610 - DNA, 1081 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggtgattaagtaccccctctctcatgcgggacggaggctagggcagggggaaggcacgtgcgggatctggatcaggtagatgttacccgaaaacagccccgttggcctctctgagcctcggtgccctccgctgtagaatgggaccggtcgtacctgaattttcgaggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttcagtgaagccatccgaaggactctggaggtgccagagactctcagcacttcggtggtagcaaaagcgggtggcctggtcaagtgagcacgcagggcccagcactagggccatgcccaaggcgccgggtggcccagttgccgggcgccggcccggttggccgaaaagccaaaggggaaccaggaagacccccggcggggccaaaggtcgagggggcggggccacacaggggaccgcccaggggcaccgcgggctaagaacccc

SEQ ID NO: 317611 - DNA, 342 bp, Homo sapiens
cctctccgtgatgtgacatttgagccaagatgatagggagccagacctgggaaatttggggacaggaaacagcaagtgccgaggctctgaggtggcagaggaacagaaagaagttgaatttggtgtggggtagttaactcatgtctgagagtcatgatggggacatgtgctaagatgcgtgagaaagtgctctggaaactctttagtgctgcataaagggttaccgttgcttttgctgatgttcgtgtgatgtatgtttcaggacctctagtgacgttgaacaagccacagggtctaccagtgacaggtatgggccggggatgtgggaagggaatgcagcgg

SEQ ID NO: 317612 - DNA, 454 bp, Homo sapiens
agaaagctctgggcttgtactcctctccagctgtccccagacagctagtcgcctccagaagtacttcacccatgcacggagagcccaaaggcccacagccacctactggtgagaggtgctgggaggttcctagagtggtggggaggtcccagcaagccaccctgtgacctcctcctgcccctttctcagtgctgtcactgatgggatcccagctgcttctgaggggaagatccaggctgccctgaaactggaacacattgatggggtcaatctcgtgagtccgggtctgggaagaggaggggtgcttctagatatagtacccctacagagaggagtcaggggtatggatttgggatggctggctctcctgtcccctaaaacaggcaagtgaccactgcctatactgtggccctgcccggagtctattgggagcagggagggtctgggtatagct

SEQ ID NO: 317613 - DNA, 1055 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaaggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggctgagatgggagaatcacctgagctcagaagatggcagctgcaataagctgagatcccgccactgtacgcaagcctaaacaacctgaatgagaccccgtctcaaaaaaacaaaacaaaacaaataccctccctgagcttcagttcccctaatggtaaaatagagaaaataatacctaaaaaa

SEQ ID NO: 317614 - DNA, 1440 bp, Homo sapiens
  misc_feature (1272)..(1272): n is a, c, g, or t
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctcancaaaaaaaaaaagggggggtcaaaaatctgagggccaattagggtaccgtttgtaaagggctaaaggagggtaaagaaggaggggggttaaagtggagggaaaggttggttggggacctcgggggaatggcacgataagggaaaaaggtggaagttgggaggtgatag

SEQ ID NO: 317615 - DNA, 1980 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacaggtaggtctggcaccctagccagcctttaaaactgcacttgatttgggaggctgaggcaggtggatcacgaggtcaggagttcaagaccagtctggccaagatggtgaaaccctgtttcaactaaaaactacaaaaattagctgggcacggtggcaggcgcctgtaaaaccagctactcgggaggctgaggcaggagaatcgcttgaacctgggaggcagaagttgcaatgagccaagatcataccattgcactccagcctgggagacagagtgaaacgctggctaaaaaaaaaaaaaactgcacttggcttagggaggcaaggagctggggagacagtggtatcagcagcagcctggggagcatttgatggcccccagaggtgtatgtgaccaggcccagctagaggaggcagcttcaggctagcaccccaacaggaaagaacagtccttaggcccggtggcttcagcaattaaatcagggttgcatctcatcatgagtggatcccacagccaggcagattgatagctgtgatcgtcctgacgtgttatgtgtccctctctggatgcaggggccatagtactgacctcactgaaacatatgatctgagaaagggggtggtgtttccccaaaggaaaaggggaggagtgatactgggtggcacagaacgagtagctgcccactgtctctcctggctttcctgttgcccagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctca

SEQ ID NO: 317616 - DNA, 1217 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacagtagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctca

SEQ ID NO: 317617 - DNA, 1186 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaagaggatcacttgagcccaggagttcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggctgagatgggagaatcacctgagctcagaagatggcagctgcaataagctgagatcccgccactgtacgcaagcctaaacaacctgaatgagaccccgtctcaaaaaaacaaaacaaaacaaataccctccctgagcttcagttcccctaatggtaaaatagagaaaataatacctaaaaaa

SEQ ID NO: 317618 - DNA, 994 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagcaaagcatgacacctccctgacgctgggcacagtgactcacacctgtaatcccaacacttctggaggccaaggcaagaggatcacttgagcccaggagttcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggctgagatgggagaatcacctgagctcagaagatggcagctgcaataagctgagatcccgccactgtacgcaagcctaaacaacctgaatgagaccccgtctcaaaaaaacaaaacaaaacaaataccctccctgagcttcagttcccctaatggtaaaatagagaaaataatacctaaaaaa

SEQ ID NO: 317619 - DNA, 604 bp, Homo sapiens
accaatcagcgcgctggctggagcgcgggtctgcccctctggacgcacatgcgcgctgtcctggctggggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaatggagttatcgcttgttctgtcacccaggctgaagtgcagtggcgcaatttcagctcactacaacctccacctcccacgttcaagcaattctcacacctcagcctcccgagtagctgggattacaggcgcccgccaccatgcctggct

SEQ ID NO: 317620 - DNA, 3105 bp, Homo sapiens
caacagttttggtacccattgagtggaaagtttgctcaactttaatttttcagtcagaatagtgtaagctaagccaatttagatatctatggtgttgactattgtttgtgctgttaattcttgttcttcttcaattaaggcatggacataatttttttcaatttttttttcaaacgatgtggaaggcttgctgctatgtgcttcatcttcagcatcatctcatcccttcttaaaatgagttatctgtttgcaaactgctgatttcttttggagaatcatccccataaacttctcataaagcatcaatgattttaccattcttccacccaagcttcacactaaatttgatgtttggttttgcttcaattttagtagaatttatgttgctctgacaggtgctcttttcaaacttacgtcttacctttttagtgcctcaaactacatcctgttcaggcatgttataacaagttagtatgagcttattttggtataaaaaatttggactccataattttttcataatatgcatttttcattaccttttggaagacaactcatatcaccttgagcttcttttcatatgcctattttccatatgtatatcttctttggtgaggtgtccttttcagatgtttgtacatttaaaaatcagttattacccactcccaccacttctattcaacatagtactggaagtactatcaagagagagcaattagacaagaaaaagaaattaaagatatctaaattggaaaggaagaagtaaaatgatctctctttgcacatcatatgatcctatgtgtagaaaactccaaagactccaccaaaaaaacctattagatctaataaatgaattcagtaaagttgcaggatataaaattaatatacaaaaatccatggccattttattcacaaataacaacctagctgagaaatcaagaaaacaatcccatttatgataacataaaacacttaagaatacatttgaccaagaagatgaaagtgcatcagtatagcctgcacactgaaaaccacaaaacattgatgaaatacattgaagaggacacaaataaataaaacgatattccatgctcatagattggaagaattaatgttgttaaagtgtccatactacccaaagcaatatatagattcaatgcaatccctatcaaaatctcatcagcattcttcacagaaatagaaaaaaatcatacaatttctgtggatccacaaaagatcccaaataaccaaagcaattctgagaaaaaaaaatcctggaggcatcatacttcccaatttaaatttatattacaaaacgagagtaatcaaaacaatacagtattggcataagagatacacaggacagtgaaatagccagaaataaatccaaacatgtatggttaatgaatttttgacaagagcaccaaaaagacaaaatgagaaaagggtagtctcttcaataaataggtgctggaatttccacatgcaaaagaatgaaattagactcttacattacaccatacacaaaaatcaatccaaaatggataaaagatctgaatgtaagacctgaagccataaatctagaagaaaacataagggaaaagctccttgacactggctttggcaatgtttccttggatatcacaccaaaacctcaggctacaaaagcaacaataaataaatgaaattatatcaatctaaaaaacttctacacagaacgaaaacaatcaacaaaatgaaaaggcaatgtacagataaggagaaaatatttgcaaaccatatatcaggcaaggttttaatattcaggatttaggaagaactcatacaactcaatagcaagacaacatataacctgattaaaaaaaagtggggaaaggacttgaatagacatttcttcaaagatgacagaaaatgaccaacaggtatatgaaatggtgctcaatatcaccagtcatcaggaaaatgcaaatcaaaactactttgagataccacctcatacatgttaggatagctattatcaaaaagacaagagctaacaagtgttggtgagggtgtggagaagagggagcacttgtacactgttagtgggaatgtattatatattggtgcagccattatggaagacagtatggaggttcctaagtaaattaaaaatagaactaccatatgacccagcaatccctcttctgggtatatccccaaagggaatgagattatctctgcactcccaagtttattgcagcacaattcacaatagtcaagatacagacacaacctaggtgttcatcaatgggcaaatggataaagaaactgtgatatagagagatcaatagatagataattagaatattatttagcctttaaaaagaaggcagtcctgtcatttgccaaaacatggatagacctagaagacattatgctaaatgaaataagccagacacagaaagaaaaatattgcgtgatctcacttatatgtggaatcaagaaaaaaaaggttaaatatatagagatagagaataaaacagtaattactaaggtcaggataaggtggaggaaatgagatgtaggtcaaaggatgcaaagtagtaaatatgcaggatgaacaagtgaaaagatcaaagatcaaatgtacaacatgaggactatagttaatacatattgtatattgtgttcaggactttttgctaaatgagtagattatacctgctcttgccaatgggggaataatcagtaactatgtgagatgatgggtatgttcattgttccactatagttttactatatatatatatatgtttcatttaacattgtgttgtataccttaatatagacaataaaatttatttaaaacataaaaaaaatcaggtttattttcttattgttgagtttaaagagttctttgtatattttggataaaagttctctatcagaatgtcctttgctaatattttatctcagtctgtggcttatcttctcattctttttacattgtcacagggtagaaatttttaattttaatgaagttcagttaatctattctttcttccattggttgtacttttggtattgcttctaaaaagtcattgctaaaccctaggtcaacca

SEQ ID NO: 317621 - DNA, 2854 bp, Homo sapiens
caacagttttggtacccattgagtggaaagtttgctcaactttaatttttcagtcagaatagtgtaagctaagccaatttagatatctatggtgttgactattgtttgtgctgttaattcttgttcttcttcaattaaggcatggacataatttttttcaatttttttttcaaacgatgtggaaggcttgctgctatgtgcttcatcttcagcatcatctcatcccttcttaaaatgagttatctgtttgcaaactgctgatttcttttggagaatcatccccataaacttctcataaagcatcaatgattttaccattcttccacccaagcttcacactaaatttgatgtttggttttgcttcaattttagtagaatttatgttgctctgacaggtgctcttttcaaacttacgtcttacctttttagtgcctcaaactacatcctgttcaggcatgttataacaagttagtatgagcttattttggtataaaaaatttggactccataattttttcataatatgcatttttcattaccttttggaagacaactcatatcaccttgagcttcttttcatatgcctattttccatatgtatatcttctttggtgaggtgtccttttcagatgtttgtacatttaaaaatcagttattacccactcccaccacttctattcaacatagtactggaagtactatcaagagagagcaattagacaagaaaaagaaattaaagatatctaaattggaaaggaagaagtaaaatgatctctctttgcacatcatatgatcctatgtgtagaaaactccaaagactccaccaaaaaaacctattagatctaataaatgaattcagtaaagttgcaggatataaaattaatatacaaaaatccatggccattttattcacaaataacaacctagctgagaaatcaagaaaacaatcccatttatgataacataaaacacttaagaatacatttgaccaagaagatgaaagtgcatcagtatagcctgcacactgaaaaccacaaaacattgatgaaatacattgaagaggacacaaataaataaaacgatattccatgctcatagattggaagaattaatgttgttaaagtgtccatactacccaaagcaatatatagattcaatgcaatccctatcaaaatctcatcagcattcttcacagaaatagaaaaaaatcatacaatttctgtggatccacaaaagatcccaaataaccaaagcaattctgagaaaaaaaaatcctggaggcatcatacttcccaatttaaatttatattacaaaacgagagtaatcaaaacaatacagtattggcataagagatacacaggacagtgaaatagccagaaataaatccaaacatgtatggttaatgaatttttgacaagagcaccaaaaagacaaaatgagaaaagggtagtctcttcaataaataggtgctggaatttccacatgcaaaagaatgaaattagactcttacattacaccatacacaaaaatcaatccaaaatggataaaagatctgaatgtaagacctgaagccataaatctagaagaaaacataagggaaaagctccttgacactggctttggcaatgtttccttggatatcacaccaaaacctcaggctacaaaagcaacaataaataaatgaaattatatcaatctaaaaaacttctacacagaacgaaaacaatcaacaaaatgaaaaggcaatgtacagataaggagaaaatatttgcaaaccatatatcaggcaaggttttaatattcaggatttaggaagaactcatacaactcaatagcaagacaacatataacctgattaaaaaaaagtggggaaaggacttgaatagacatttcttcaaagatgacagaaaatgaccaacaggtatatgaaatggtgctcaatatcaccagtcatcaggaaaatgcaaatcaaaactactttgagataccacctcatacatgttaggatagctattatcaaaaagacaagagctaacaagtgttggtgagggtgtggagaagagggagcacttgtacactgttagtgggaatgtattatatattggtgcagccattatggaagacagtatggaggttcctaagtaaattaaaaatagaactaccatatgacccagcaatccctcttctgggtatatccccaaagggaatgagattatctctgcactcccaagtttattgcagcacaattcacaatagtcaagatacagacacaacctaggtgttcatcaatgggcaaatggataaagaaactgtgatatagagagatcaatagatagataattagaatattatttagcctttaaaaagaaggcagtcctgtcatttgccaaaacatggatagacctagaagacattatgctaaatgaaataagccagacacagaaagaaaaatattgcgtgatctcacttatatgtggaatcaagaaaaaaaaggttaaatatatagagatagagaataaaacagtaattactaaggtcaggataaggtggaggaaatgagatgtaggtcaaaggatgcaaagtagtaaatatgcaggatgaacaagtgaaaagatcaaagatcaaatgtacaacatgaggactatagttaatacatattgtatattgtgttcaggactttttgctaaatgagtagattatacctgctcttgccaatgggggaataatcagtaactatgtgagatgatgggtatgttcattgttccactatagttttactatatatatatatatgtttcatttaacattgtgttgtataccttaatatagacaataaaatttatttaaaacata

SEQ ID NO: 317622 - DNA, 1548 bp, Homo sapiens
ctctcagggatcccgcccgtagagatgatgaaaacataagggaaaagctccttgacactggctttggcaatgtttccttggatatcacaccaaaacctcaggctacaaaagcaacaataaataaatgaaattatatcaatctaaaaaacttctacacagaacgaaaacaatcaacaaaatgaaaaggcaatgtacagataaggagaaaatatttgcaaaccatatatcaggcaaggttttaatattcaggatttaggaagaactcatacaactcaatagcaagacaacatataacctgattaaaaaaaagtggggaaaggacttgaatagacatttcttcaaagatgacagaaaatgaccaacaggtatatgaaatggtgctcaatatcaccagtcatcaggaaaatgcaaatcaaaactactttgagataccacctcatacatgttaggatagctattatcaaaaagacaagagctaacaagtgttggtgagggtgtggagaagagggagcacttgtacactgttagtgggaatgtattatatattggtgcagccattatggaagacagtatggaggttcctaagtaaattaaaaatagaactaccatatgacccagcaatccctcttctgggtatatccccaaagggaatgagattatctctgcactcccaagtttattgcagcacaattcacaatagtcaagatacagacacaacctaggtgttcatcaatgggcaaatggataaagaaactgtgatatagagagatcaatagatagataattagaatattatttagcctttaaaaagaaggcagtcctgtcatttgccaaaacatggatagacctagaagacattatgctaaatgaaataagccagacacagaaagaaaaatattgcgtgatctcacttatatgtggaatcaagaaaaaaaaggttaaatatatagagatagagaataaaacagtaattactaaggtcaggataaggtggaggaaatgagatgtaggtcaaaggatgcaaagtagtaaatatgcaggatgaacaagtgaaaagatcaaagatcaaatgtacaacatgaggactatagttaatacatattgtatattgtgttcaggactttttgctaaatgagtagattatacctgctcttgccaatgggggaataatcagtaactatgtgagatgatgggtatgttcattgttccactatagttttactatatatatatatatgtttcatttaacattgtgttgtataccttaatatagacaataaaatttatttaaaacataaaaaaaatcaggtttattttcttattgttgagtttaaagagttctttgtatattttggataaaagttctctatcagaatgtcctttgctaatattttatctcagtctgtggcttatcttctcattctttttacattgtcacagggtagaaatttttaattttaatgaagttcagttaatctattctttcttccattggttgtacttttggtattgcttctaaaaagtcattgctaaaccctaggtcaacca

SEQ ID NO: 317623 - DNA, 317 bp, Homo sapiens
aaacaagtctcgttctgtcacccacgctggagttcagtggcgggattttggttcattgcagcctttgcctcgcaggagaattgcttgaacccaggaggtggaggttgcagtgagccaagatcgcaccaccgcatgagagagagagattactatttcttgtccctttttctcagtttgattatatttatatacatatgtcagtaaatctgttttcagtattgatgtttaataaagaatgtacaatggccagagttctactctttcctctggagcattaaaatatattgccattcctattaaaacgtatttgaatgtga

SEQ ID NO: 317624 - DNA, 3266 bp, Homo sapiens
atggcctcctttcatttttggggggggggctccctgtttgatgtggctctggggcccagcagccccaggtggcagagcagcctccactgggtcggaaatacccagggttaccccagatgacacaccgtcttcagcaaagagaaagggttgggagaaaggtggcggtgctttcggagggaataaaatggaaggagaatcaagcagatttgaaatccacactccagtttctgacaagaaaaagaaaaagtgttctatacataaggaaagacctcagaaacattcccacgaaattttcagagactcctccctggtgaatgaacagtctcaaataactaggaggaaaaagaggaaaaaagatttccagcatctcatttcttctcctttgaaaaaatccagaatctgtgatgagactgcaaatgccacttccacactcaaaaagagaaaaaagagaagatatagtgctttggaggtggacgaggaagcaggtgttacagttgtccttgtggataaagaaaatattaacaacacaccaaagcattttagaaaggatgttgatgttgtttgtgttgatatgagcatagaacagaagttaccaagaaagcctaaaacagacaaatttcaggtacttgctaagtcacatgcacataaatcagaagccctgcacagtaaagttagggagaaaaagaataaaaagcatcagaggaaagctgcatcctgggagagccagcgggcaagggacaccctgcctcagtcagaatcccaccaggaggagtcctggctttctgtgggtccagggggtgaaattacagaactaccagcatctgctcataaaaacaagtctaagaaaaaaaagaaaaagtccagtaaccgggaatatgagacactggccatgcctgaaggatcgcaagcaggcagagaggccgggactgatatgcaggaatcccagcctactgtgggcttggatgatgaaactccacaactactaggacctactcacaaaaaaaagtctaagaaaaaaaagaagaaaaagtccaatcaccaggaatttgaggcattggccatgcctgaaggatcacaagtgggcagtgaggttggggctgatatgcaggaatcccggcctgctgtgggcctgcatggtgaaactgcaggaataccagcacctgcttataaaaacaagtctaagaaaaaaaagaaaaagtccaatcaccaggaatttgaggcagtggccatgcctgagagcctcgagagtgcataccctgaaggatcacaggtgggcagtgaggttgggactgtggaaggcagtacagctcttaaagggttcaaggaatccaacagtacaaagaagaagtctaagaaaaggaagcttacgtctgtcaaaagggcacgagtgtctggtgatgatttttcagtgcccagtaagaactctgagagcacactctttgattcagtagaaggtgatggcgccatgatggaagaaggtgtgaaatctaggccccgacaaaagaaaacccaggcctgtttggcaagcaagcacgtgcaagaggcgccaaggttagaacctgcaaatgaagaacacaatgtggaaacagctgaagattccgaaataagatacttatctgcagattcaggagatgccgatgattcagatgcggatttgggttctgccgtgaaacagcttcaggagttcattcctaacatcaaggacagggccaccagcacaatcaagcggatgtaccgggacgacttggaacggtttaaggaatttaaagcacaaggtgtcgctattaaatttggcaagttttctgtaaaggaaaataagcagttagagaaaaatgtggaagactttctagccctgacaggcattgagagtgcagacaagctcctgtacacggacagatatcctgaggaaaaatctgtgatcaccaacttaaaaaggagatactcgtttagattacacattggtaggaacattgcccggccctggaaacttatatactatcgagcaaagaagatgttcgatgtcaacaattacaaaggcaggtatagcgaaggagatactgagaagttaaagatgtaccattctctccttgggaatgactggaagacgattggtgagatggtggcccgaagtagcctctccgtggccctcaagttctcacagatcagcagtcaaagaaatcgtggtgcttggagtaagtctgaaacccggaaactaatcaaggctgtcgaagaagtgattctgaagaagatgtctccccaggagttaaaagaggtggattccaaactccaagaaaatcctgaaagttgcctatcaattgttcgggaaaaactctacaagggcatatcttgggtagaagtagaagctaaagtgcaaaccagaaattggatgcagtgtaaaagtaagtggacagaaattctaaccaagaggatgactaatggtcggcgtatatactatggcatgaatgccctgcgggccaaggtcagccttattgaaaggttgtatgaaataaatgtggaagatactaatgaaatagactgggaagatcttgctagtgccataggtgatgttcctccatcttacgttcaaactaaattttctaggctgaaagctgtctatgttccattttggcagaaaaagacttttccagagatcatcgactacctttatgagacgactctacctttgctgaaggaaaagttagaaaaaatgatggagaaaaaaggcactaaaatccagactcctgcagcacccaagcaagttttcccatttcgagacatcttttattatgaagacgatagtgaaggagaggacatagaaaaagaaagcgaaggccaggcgccatgcatggctcacgcctgtaattccagtactttgggaggccaaggccggtggatcatctgaggtcaggagttcgagaccggcctgaccaacatggtgaagacctgtcactattaaaaatgcgaaaattagccgggtgtggtagtgcacacctgtaatttcaactacttgggaggctgaggcaggagaattgcttgaacccaggaggtggaggttgcagtgagccaagatcgcaccaccgcatgagagagagagattactatttcttgtccctttttctcagtttgattatatttatatacatatgtcagtaaatctgttttcagtattgatgtttaataaagaatgtacaatggccagagttctactctttcctctggagcattaaaatatattgccattcctattaaaacgtatttgaatgtga

SEQ ID NO: 317625 - DNA, 2285 bp, Homo sapiens
atggcctcctttcatttttggggggggggctccctgtttgatgtggctctggggcccagcagccccaggtggcagagcagcctccactgggtcggaaatacccagggttaccccagatgacacaccgtcttcagcaaagagaaagggttgggagaaaggtggcggtgctttcggagggaataaaatggaaggagaatcaagcagatttgaaatccacactccagtttctgacaagaaaaagaaaaagtgttctatacataaggaaagacctcagaaacattcccacgaaattttcagagactcctccctggtgaatgaacagtctcaaataactaggaggaaaaagaggaaaaaagatttccagcatctcatttcttctcctttgaaaaaatccagaatctgtgatgagactgcaaatgccacttccacactcaaaaagagaaaaaagagaagatatagtgctttggaggtggacgaggaagcaggtgttacagttgtccttgtggataaagaaaatattaacaacacaccaaagcattttagaaaggatgttgatgttgtttgtgttgatatgagcatagaacagaagttaccaagaaagcctaaaacagacaaatttcaggtacttgctaagtcacatgcacataaatcagaagccctgcacagtaaagttagggagaaaaagaataaaaagcatcagaggaaagctgcatcctgggagagccagcgggcaagggacaccctgcctcagtcagaatcccaccaggaggagtcctggctttctgtgggtccagggggtgaaattacagaactaccagcatctgctcataaaaacaagtctaagaaaaaaaagaaaaagtccagtaaccgggaatatgagacactggccatgcctgaaggatcgcaagcaggcagagaggccgggactgatatgcaggaatcccagcctactgtgggcttggatgatgaaactccacaactactaggacctactcacaaaaaaaagtctaagaaaaaaaagaagaaaaagtccaatcaccaggaatttgaggcattggccatgcctgaaggatcacaagtgggcagtgaggttggggctgatatgcaggaatcccggcctgctgtgggcctgcatggtgaaactgcaggaataccagcacctgcttataaaaacaagtctaagaaaaaaaagaaaaagtccaatcaccaggaatttgaggcagtggccatgcctgagagcctcgagagtgcataccctgaaggatcacaggtgggcagtgaggttgggactgtggaaggcagtacagctcttaaagggttcaaggaatccaacagtacaaagaagaagtctaagaaaaggaagcttacgtctgtcaaaagggcacgagtgtctggtgatgatttttcagtgcccagtaagaactctgagagcacactctttgattcagtagaaggtgatggcgccatgatggaagaaggtgtgaaatctaggccccgacaaaagaaaacccaggcctgtttggcaagcaagcacgtgcaagaggcgccaaggttagaacctgcaaatgaagaacacaatgtggaaacagctgaagattccgaaataagatacttatctgcagattcaggagatgccgatgattcagatgcggatttgggttctgccgtgaaacagcttcaggagttcattcctaacatcaaggacagggccaccagcacaatcaagcggatgtaccgggacgacttggaacggtttaaggaatttaaagcacaaggtgtcgctattaaatttggcaagttttctgtaaaggaaaataagcagttagagaaaaatgtggaagactttctagccctgacaggcattgagagtgcagacaagctcctgtacacggacagatatcctgaggaaaaatctgtgatcaccaacttaaaaaggagatactcgtttagattacacattggtaggaacattgcccggccctggaaacttatatactatcgagcaaagaagatgttcgatgtcaacaattacaaaggcaggtattagccgaaaggaagaattacttggagaacagtataacaagaattggtacccattctcctcccttgggggaaattgaactgggacaagaaccgaattgggtggcacaatggggtggccccgaagttaagcctctcccggggggcccctcaaaggttctccaccagattcaagccggtcacagaaacatcggggctgcgctgggaattaagatcttgaaacccgggaaacttattccaaggtg

SEQ ID NO: 317626 - DNA, 1415 bp, Homo sapiens
  misc_feature (13)..(13): n is a, c, g, or t
  misc_feature (28)..(28): n is a, c, g, or t
  misc_feature (41)..(41): n is a, c, g, or t
  misc_feature (53)..(53): n is a, c, g, or t
  misc_feature (67)..(67): n is a, c, g, or t
  misc_feature (103)..(103): n is a, c, g, or t
cagtgggggtttnatcgcctatgctacntgcttacctcacnaagtggctaaangattagcacctgtnatcaccaacttaaacaggagatactcgtttacattncacattggtaggaacattgcccggccctggaaacttatatactatcgagcaaagaagatgttcgatgtcaacaattacaaaggcaggtatagcgaaggagatactgagaagttaaagatgtaccattctctccttgggaatgactggaagacgattggtgagatggtggcccgaagtagcctctccgtggccctcaagttctcacagatcagcagtcaaagaaatcgtggtgcttggagtaagtctgaaacccggaaactaatcaaggctgtcgaagaagtgattctgaagaagatgtctccccaggagttaaaagaggtggattccaaactccaagaaaatcctgaaagttgcctatcaattgttcgggaaaaactctacaagggcatatcttgggtagaagtagaagctaaagtgcaaaccagaaattggatgcagtgtaaaagtaagtggacagaaattctaaccaagaggatgactaatggtcggcgtatatactatggcatgaatgccctgcgggccaaggtcagccttattgaaaggttgtatgaaataaatgtggaagatactaatgaaatagactgggaagatcttgctagtgccataggtgatgttcctccatcttacgttcaaactaaattttctaggctgaaagctgtctatgttccattttggcagaaaaagacttttccagagatcatcgactacctttatgagacgactctacctttgctgaaggaaaagttagaaaaaatgatggagaaaaaaggcactaaaatccagactcctgcagcacccaagcaagttttcccatttcgagacatcttttattatgaagacgatagtgaaggagaggacatagaaaaagaaagcgaaggccaggcgccatgcatggctcacgcctgtaattccagtactttgggaggccaaggccggtggatcatctgaggtcaggagttcgagaccggcctgaccaacatggtgaagacctgtcactattaaaaatgcgaaaattagccgggtgtggtagtgcacacctgtaatttcaactacttgggaggctgaggcaggagaattgcttgaacccaggaggtggaggttgcagtgagccaagatcgcaccaccgcatgagagagagagattactatttcttgtccctttttctcagtttgattatatttatatacatatgtcagtaaatctgttttcagtattgatgtttaataaagaatgtacaatggccagagttctactctttcctctggagcattaaaatatattgccattcctattaaaacgtatttgaatgtga

SEQ ID NO: 317627 - DNA, 2986 bp, Homo sapiens
atggcctcctttcatttttggggggggggctccctgtttgatgtggctctggggcccagcagccccaggtggcagagcagcctccactgggtcggaaatacccagggttaccccagatgacacaccgtcttcagcaaagagaaagggttgggagaaaggtggcggtgctttcggagggaataaaatggaaggagaatcaagcagatttgaaatccacactccagtttctgacaagaaaaagaaaaagtgttctatacataaggaaagacctcagaaacattcccacgaaattttcagagactcctccctggtgaatgaacagtctcaaataactaggaggaaaaagaggaaaaaagatttccagcatctcatttcttctcctttgaaaaaatccagaatctgtgatgagactgcaaatgccacttccacactcaaaaagagaaaaaagagaagatatagtgctttggaggtggacgaggaagcaggtgttacagttgtccttgtggataaagaaaatattaacaacacaccaaagcattttagaaaggatgttgatgttgtttgtgttgatatgagcatagaacagaagttaccaagaaagcctaaaacagacaaatttcaggtacttgctaagtcacatgcacataaatcagaagccctgcacagtaaagttagggagaaaaagaataaaaagcatcagaggaaagctgcatcctgggagagccagcgggcaagggacaccctgcctcagtcagaatcccaccaggaggagtcctggctttctgtgggtccagggggtgaaattacagaactaccagcatctgctcataaaaacaagtctaagaaaaaaaagaaaaagtccagtaaccgggaatatgagacactggccatgcctgaaggatcgcaagcaggcagagaggccgggactgatatgcaggaatcccagcctactgtgggcttggatgatgaaactccacaactactaggacctactcacaaaaaaaagtctaagaaaaaaaagaagaaaaagtccaatcaccaggaatttgaggcattggccatgcctgaaggatcacaagtgggcagtgaggttggggctgatatgcaggaatcccggcctgctgtgggcctgcatggtgaaactgcaggaataccagcacctgcttataaaaacaagtctaagaaaaaaaagaaaaagtccaatcaccaggaatttgaggcagtggccatgcctgagagcctcgagagtgcataccctgaaggatcacaggtgggcagtgaggttgggactgtggaaggcagtacagctcttaaagggttcaaggaatccaacagtacaaagaagaagtctaagaaaaggaagcttacgtctgtcaaaagggcacgagtgtctggtgatgatttttcagtgcccagtaagaactctgagagcacactctttgattcagtagaaggtgatggcgccatgatggaagaaggtgtgaaatctaggccccgacaaaagaaaacccaggcctgtttggcaagcaagcacgtgcaagaggcgccaaggttagaacctgcaaatgaagaacacaatgtggaaacagctgaagattccgaaataagatacttatctgcagattcaggagatgccgatgattcagatgcggatttgggttctgccgtgaaacagcttcaggagttcattcctaacatcaaggacagggccaccagcacaatcaagcggatgtaccgggacgacttggaacggtttaaggaatttaaagcacaaggtgtcgctattaaatttggcaagttttctgtaaaggaaaataagcagttagagaaaaatgtggaagactttctagccctgacaggcattgagagtgcagacaagctcctgtacacggacagatatcctgaggaaaaatctgtgatcaccaacttaaaaaggagatactcgtttagattacacattggtaggaacattgcccggccctggaaacttatatactatcgagcaaagaagatgttcgatgtcaacaattacaaaggcaggtatagcgaaggagatactgagaagttaaagatgtaccattctctccttgggaatgactggaagacgattggtgagatggtggcccgaagtagcctctccgtggccctcaagttctcacagatcagcagtcaaagaaatcgtggtgcttggagtaagtctgaaacccggaaactaatcaaggctgtcgaagaagtgattctgaagaagatgtctccccaggagttaaaagaggtggattccaaactccaagaaaatcctgaaagttgcctatcaattgttcgggaaaaactctacaagggcatatcttgggtagaagtagaagctaaagtgcaaaccagaaattggatgcagtgtaaaagtaagtggacagaaattctaaccaagaggatgactaatggtcggcgtatatactatggcatgaatgccctgcgggccaaggtcagccttattgaaaggttgtatgaaataaatgtggaagatactaatgaaatagactgggaagatcttgctagtgccataggtgatgttcctccatcttacgttcaaactaaattttctaggctgaaagctgtctatgttccattttggcagaaaaagacttttccagagatcatcgactacctttatgagacgactctacctttgctgaaggaaaagttagaaaaaatgatggagaaaaaaggcactaaaatccagactcctgcagcacccaagcaagttttcccatttcgagacatcttttattatgaagacgatagtgaaggagaggacatagaaaaagaaagcgaaggggaattccgtaaagcctagaatcaaaagaaaacaaaacccatagtcaagccacagacaagcccagaataatatggccaggggatcaatccgattagccgactggcccagatccagcaggcaaaaaaggagaaggagccagagtacacgctcctc

SEQ ID NO: 317628 - DNA, 3116 bp, Homo sapiens
atggcctcctttcatttttggggggggggctccctgtttgatgtggctctggggcccagcagccccaggtggcagagcagcctccactgggtcggaaatacccagggttaccccagatgacacaccgtcttcagcaaagagaaagggttgggagaaaggtggcggtgctttcggagggaataaaatggaaggagaatcaagcagatttgaaatccacactccagtttctgacaagaaaaagaaaaagtgttctatacataaggaaagacctcagaaacattcccacgaaattttcagagactcctccctggtgaatgaacagtctcaaataactaggaggaaaaagaggaaaaaagatttccagcatctcatttcttctcctttgaaaaaatccagaatctgtgatgagactgcaaatgccacttccacactcaaaaagagaaaaaagagaagatatagtgctttggaggtggacgaggaagcaggtgttacagttgtccttgtggataaagaaaatattaacaacacaccaaagcattttagaaaggatgttgatgttgtttgtgttgatatgagcatagaacagaagttaccaagaaagcctaaaacagacaaatttcaggtacttgctaagtcacatgcacataaatcagaagccctgcacagtaaagttagggagaaaaagaataaaaagcatcagaggaaagctgcatcctgggagagccagcgggcaagggacaccctgcctcagtcagaatcccaccaggaggagtcctggctttctgtgggtccagggggtgaaattacagaactaccagcatctgctcataaaaacaagtctaagaaaaaaaagaaaaagtccagtaaccgggaatatgagacactggccatgcctgaaggatcgcaagcaggcagagaggccgggactgatatgcaggaatcccagcctactgtgggcttggatgatgaaactccacaactactaggacctactcacaaaaaaaagtctaagaaaaaaaagaagaaaaagtccaatcaccaggaatttgaggcattggccatgcctgaaggatcacaagtgggcagtgaggttggggctgatatgcaggaatcccggcctgctgtgggcctgcatggtgaaactgcaggaataccagcacctgcttataaaaacaagtctaagaaaaaaaagaaaaagtccaatcaccaggaatttgaggcagtggccatgcctgagagcctcgagagtgcataccctgaaggatcacaggtgggcagtgaggttgggactgtggaaggcagtacagctcttaaagggttcaaggaatccaacagtacaaagaagaagtctaagaaaaggaagcttacgtctgtcaaaagggcacgagtgtctggtgatgatttttcagtgcccagtaagaactctgagagcacactctttgattcagtagaaggtgatggcgccatgatggaagaaggtgtgaaatctaggccccgacaaaagaaaacccaggcctgtttggcaagcaagcacgtgcaagaggcgccaaggttagaacctgcaaatgaagaacacaatgtggaaacagctgaagattccgaaataagatacttatctgcagattcaggagatgccgatgattcagatgcggatttgggttctgccgtgaaacagcttcaggagttcattcctaacatcaaggacagggccaccagcacaatcaagcggatgtaccgggacgacttggaacggtttaaggaatttaaagcacaaggtgtcgctattaaatttggcaagttttctgtaaaggaaaataagcagttagagaaaaatgtggaagactttctagccctgacaggcattgagagtgcagacaagctcctgtacacggacagatatcctgaggaaaaatctgtgatcaccaacttaaaaaggagatactcgtttagattacacattggtaggaacattgcccggccctggaaacttatatactatcgagcaaagaagatgttcgatgtcaacaattacaaaggcaggtatagcgaaggagatactgagaagttaaagatgtaccattctctccttgggaatgactggaagacgattggtgagatggtggcccgaagtagcctctccgtggccctcaagttctcacagatcagcagtcaaagaaatcgtggtgcttggagtaagtctgaaacccggaaactaatcaaggctgtcgaagaagtgattctgaagaagatgtctccccaggagttaaaagaggtggattccaaactccaagaaaatcctgaaagttgcctatcaattgttcgggaaaaactctacaagggcatatcttgggtagaagtagaagctaaagtgcaaaccagaaattggatgcagtgtaaaagtaagtggacagaaattctaaccaagaggatgactaatggtcggcgtatatactatggcatgaatgccctgcgggccaaggtcagccttattgaaaggttgtatgaaataaatgtggaagatactaatgaaatagactgggaagatcttgctagtgccataggtgatgttcctccatcttacgttcaaactaaattttctaggctgaaagctgtctatgttccattttggcagaaaaagacttttccagagatcatcgactacctttatgagacgactctacctttgctgaaggaaaagttagaaaaaatgatggagaaaaaaggcactaaaatccagactcctgcagcacccaagcaagttttcccatttcgagacatcttttattatgaagacgatagtgaaggagaggacatagaaaaagaaagcgaaggccaggcgccatgcatggctcacgcctgtaattccagtactttgggaggccaaggccggtggatcatctgaggtcaggagttcgagaccggcctgaccaacatggtgaagacctgtcactattaaaaatgcgaaaattagccgggtgtggtagtgcacacctgtaatttcaactacttgggaggctgaggcaggagaattgcttgaacccaggaggtggaggttgcagtgagccaagatcgcaccaccgcacttcagcctgggccacagagcgagactccatctc

SEQ ID NO: 317629 - DNA, 1741 bp, Homo sapiens
gagaaaggtggcggcgctttcggagggttagaacctgcaaatgaagaacacaatgtggaaacagctgaagattccgaaataagatacttatctgcagattcaggagatgccgatgattcagatgcggatttgggttctgccgtgaaacagcttcaggagttcattcctaacatcaaggacagggccaccagcacaatcaagcggatgtaccgggacgacttggaacggtttaaggaatttaaagcacaaggtgtcgctattaaatttggcaagttttctgtaaaggaaaataagcagttagagaaaaatgtggaagactttctagccctgacaggcattgagagtgcagacaagctcctgtacacggacagatatcctgaggaaaaatctgtgatcaccaacttaaaaaggagatactcgtttagattacacattggtaggaacattgcccggccctggaaacttatatactatcgagcaaagaagatgttcgatgtcaacaattacaaaggcaggtatagcgaaggagatactgagaagttaaagatgtaccattctctccttgggaatgactggaagacgattggtgagatggtggcccgaagtagcctctccgtggccctcaagttctcacagatcagcagtcaaagaaatcgtggtgcttggagtaagtctgaaacccggaaactaatcaaggctgtcgaagaagtgattctgaagaagatgtctccccaggagttaaaagaggtggattccaaactccaagaaaatcctgaaagttgcctatcaattgttcgggaaaaactctacaagggcatatcttgggtagaagtagaagctaaagtgcaaaccagaaattggatgcagtgtaaaagtaagtggacagaaattctaaccaagaggatgactaatggtcggcgtatatactatggcatgaatgccctgcgggccaaggtcagccttattgaaaggttgtatgaaataaatgtggaagatactaatgaaatagactgggaagatcttgctagtgccataggtgatgttcctccatcttacgttcaaactaaattttctaggctgaaagctgtctatgttccattttggcagaaaaagacttttccagagatcatcgactacctttatgagacgactctacctttgctgaaggaaaagttagaaaaaatgatggagaaaaaaggcactaaaatccagactcctgcagcacccaagcaagttttcccatttcgagacatcttttattatgaagacgatagtgaaggagaggacatagaaaaagaaagcgaaggccaggcgccatgcatggctcacgcctgtaattccagtactttgggaggccaaggccggtggatcatctgaggtcaggagttcgagaccggcctgaccaacatggtgaagacctgtcactattaaaaatgcgaaaattagccgggtgtggtagtgcacacctgtaatttcaactacttgggaggctgaggcaggagaattgcttgaacccaggaggtggaggttgcagtgagccaagatcgcaccaccgcatgagagagagagattactatttcttgtccctttttctcagtttgattatatttatatacatatgtcagtaaatctgttttcagtattgatgtttaataaagaatgtacaatggccagagttctactctttcctctggagcattaaaatatattgccattcctattaaaacgtatttgaatgtga

SEQ ID NO: 317630 - DNA, 307 bp, Homo sapiens
  misc_feature (59)..(59): n is a, c, g, or t
  misc_feature (62)..(62): n is a, c, g, or t
tgcccaccccttgtgtccccccctccgcaaccggacagaaaccggcttactaggaactnggnacaacagttttgaggaggaagaagaatgactgtaaaggaaggagcagtactgttttcatgaggacctactatgtgccagacattattctaggtgctggggctaccatggtgagcaagacagtccctgctgcttctaggagttcatattcgaatggaagaaaactatttaaaattgtacttattatctcaaattttttcaggtattgataaatactatgaagagtataaaatgacacaataaagag

SEQ ID NO: 317631 - DNA, 255 bp, Homo sapiens
atatattctggaaaagaagaggaggaggaagaagaatgactgtaaaggaaggagcagtactgttttcatgaggacctactatgtgccagacattattctaggtgctggggctaccatggtgagcaagacagtccctgctgcttctaggagttcatattcgaatggaagaaaactatttaaaattgtacttattatctcaaattttttcaggtattgataaatactatgaagagtataaaatgacacaataaagag

SEQ ID NO: 317632 - DNA, 1861 bp, Homo sapiens
gggaatatagttacttggcaaagtctttcaggaaggaagcccttccttatgttacatgtggaaagcctgccttccaagacatgtggaagtaattgatccacctgccagagaaacacaggctcagaggatgcctgggaacagggaggatgggattagtggaagcttaatggaaaaggaaagttatgatcctccaagacccttaattgatagaccataccaggttctgcaggtcagcatcattgtgtaatgagagtgaagtaggggaccctgtggttcaaccttagaatctgtttcctgtaggctctttctgctgtctatattcattaaagttttccacttcaccctcccatagtctagagggatgcccattccatggtcctccagagaatagttttgacttaacatgtctgtttagcccacatcacgtcagttatcaacaccgccactgtgcttactgttcctacagccacaccaggcttgaagagttagtgagaccaacaaataattggaagtattggaaaaagcaaaatacatggggacaaaaaaaatacagtgaaattctttttatcaaactgatgctgtgagaaaccagatgaatgccagtttggctttatttctaagaatctgggtcttcattctctggtgtagaaggaatgcaaaaaactataacaacaacaacaaaaacatattttgaaaagacatattctgacatctctgcttgtgtgtggtaaggcaggttcctatcagacatttatccctttggtcaagatcccttttgctcatccagggtttcatactcaatatcgcttaaaaaaaaaaaagtatcagctagggatgactctggaagtatgagtatcatggtggggaggaaggaattttttttaaatgtaaatgacccccatttaccagaccctaatcaaagtcacttaagggaatccctcagccttttatttggaaacagttgaaataaactggcagcagctagatcagagtatcttgctttattttataaaggccaaaggtagtatgaagtttggaccaaaaaggtaaatagatccattccagcacctgatactgatttttcaaggctctatgaaaggtcaaaaatttcattaaacaagaccagttctccctcttccccctgtcccaagaaatcttaggcatgaaaaggataaggaaacagctcctggaatgatacatttgcatagtgccctagtagcaggttgggaaaaagttataatataagaaacaaccttcgaaaacaggccttttatctcaaagataaaatgtctttcttgtggtctttcatcactatctccgtggtggaaggttcccctagttccaacatatttccattaaaatagtcaaagccacggcattgggatgtcagatgcctctctttctttgtggtaatcggaatttaaaattatacagttgcctctgaatttctcatgcacaaagccaaaccactgataagagataaagcagtctgaagcctgctgcttcagccagcacagcacaccacacacgctcgcacacacacagaaatttacagggtaagagagattaggaagataattttggtggtagagtcaagaagaggttgaagaggtgctaatattaaaagagagatttgaataaaatgtttttagaattcataggcattatgatattctattgtaaaatgctattggttaaaattatctttgtatgggcaaactgagtctctgtctccagctgtctgtgaacagctattcagttcactaaacctcagcacctcatctgtggaatgagcaccatagtagctcctgtcataaaggttaaatgattttgtaaaggggaactcgcgaacccggtccga

SEQ ID NO: 317633 - DNA, 4881 bp, Homo sapiens
gggaatatagttacttggcaaagtctttcaggaaggaagcccttccttatgttacatgtggaaagcctgccttccaagacatgtggaagtaattgatccacctgccagagaaacacaggctcagaggatgcctgggaacagggaggatgggattagtggaagcttaatggaaaaggaaagttatgatcctccaagacccttaattgatagaccataccaggttctgcaggtcagcatcattgtgtaatgagagtgaagtaggggaccctgtggttcaaccttagaatctgtttcctgtaggctctttctgctgtctatattcattaaagttttccacttcaccctcccatagtctagagggatgcccattccatggtcctccagagaatagttttgacttaacatgtctgtttagcccacatcacgtcagttatcaacaccgccactgtgcttactgttcctacagccacaccaggcttgaagagttagtgagaccaacaaataattggaagtattggaaaaagcaaaatacatggggacaaaaaaaatacagtgaaattctttttatcaaactgatgctgtgagaaaccagatgaatgccagtttggctttatttctaagaatctgggtcttcattctctggtgtagaaggaatgcaaaaaactataacaacaacaacaaaaacatattttgaaaagacatattctgacatctctgcttgtgtgtggtaaggcaggttcctatcagacatttatccctttggtcaagatcccttttgctcatccagggtttcatactcaatatcgcttaaaaaaaaaaaagtatcagctagggatgactctggaagtatgagtatcatggtggggaggaaggaattttttttaaatgtaaatgacccccatttaccagaccctaatcaaagtcacttaagggaatccctcagccttttatttggaaacagttgaaataaactggcagcagctagatcagagtatcttgctttattttataaaggccaaaggtagtatgaagtttggaccaaaaaggtaaatagatccattccagcacctgatactgatttttcaaggctctatgaaaggtcaaaaatttcattaaacaagaccagttctccctcttccccctgtcccaagaaatcttaggcatgaaaaggataaggaaacagctcctggaatgatacatttgcatagtgccctagtagcaggttgggaaaaagttataatataagaaacaaccttcgaaaacaggccttttatctcaaagataaaatgtctttcttgtggtctttcatcactatctccgtggtggaaggttcccctagttccaacatatttccattaaaatagtcaaagccacggcattgggatgtcagatgcctctctttctttgtggtaatcggaatttaaaattatacagttgcctctgaatttctcatgcacaaagccaaaccactgataagagataaagcagtctgaagcctgctgcttcagccagcacagcacaccacacacgctcgcactttcaaaagcaatgtgatttctatggttcttaaaagctttcttcataagggagtccctgaaatttctcaaggcaggtttgaatggcaaagggaaaataattacttgtgggaggtcctccttttgagtattgttagagcatacatgtaaaagaaaataacctttttggggcaactcatgctcacacatgctgttttctttggttctccccctaccttccttttgtagatattgacagaataggaggaaatgagcatccttatttgagaaagagcaagaatgtcatgagcccttgatgcaatagtaagtgtgatgtcatcatacagtgttaatgatgctatcaaatccatcaataaacagtctcaaaccttccaacaacagtgctcactgctgctcctcaacttcagcccagcaagcagtaatatcatcacccattttgagatatgcaggtggaatagaacaaagaaacagccactgtaatcgagaagcatgtttactgtctaaatccacctgttgcagtaggaagccagagtggggttccaaatgcctcattaagtatgtggacagcctcactagtaagtgagtgaatttggcttcatcactgaacattagctaaggtcagcttaataacacaaatatgaggccgacttctttgcgagaagagaaaagaaaacatctgcttgatttaaaatccaccccacatgcctagagttgtctaatagtccctcactttccaatggcttcacatcctacttctacatttggggttttttggtgaaatcagagatagctcaggatttcataaaacgagaaactccaaactggtctattaggttccatgggaacacttgtagccaaaggattgtctgagggcaggaagacgacacttgtcaacaaggaagacagtgtttctttaggtcccatattcatctaattcatggggttctaacattttggggggccatagatctttgacaatctgagccatctatgaaactctccccaaaagaaccaccccacaaaatcttgcaaaacgtaagagattttcctggatctgaagctacccgaagacatgggaagagttgtattctattattcaattttaagaatatttattaatattcactgagctattgctagccactgtgctaaacattttacatacattctcctatttcatcctcaaaacaatcctttgagttgggttttaatatagttccaatattcggatgtgaaaactgaggcttatagtggctaagaaacttgcccaaagccactacctagaaaatggcagagctggaatgtaggtttaactcctgaccactatgctataaagtcaccacatgtcaaactaattttcaagttgttgggacatgtcccctactaggttttaaactagatcttccttggtagatgaagctatagaacttctattttccctgctttctgtagtctctcacagtgacagcatctatactaaagtatagatacctaaggggaaaatatagaaagcctgcctgaataatagaatctagaacaacaacaaaaatattaattttttctgtgtatgcttaggtcaagcttaaaaaaaaaaaaaaaagaccggaaaatacctgggttgttagcctcacatttaggaaaaaattgtaatactcaattatctgtgtgtgtggctaaacaagtcagcatttctgcacacatacatctctttcctttatacttcccttcaaaagacaaatatcttacttttgatctttgacactatttggtcagtattcttctttacctttacttgtggcaaaactcaaggaagcgatcaaatagagggaagctcatttctatcattgtctctgtttccctataagaaagaactaccagggactcactgactgcattaggcatacaatgtcagagctgagctgaccactctggtcctgtaatgtctttggcctcacaccttggcagccatcattaatgggccatacccttccccaggtgcagaattctcctccccagagcactcaggccgttactaccaatttatctgagttggaaataagactcatttgccagttcttatttttaaagtggcaccctttaactttgaacctgtgtattttacactggcatcctagattcagcaatgaggtttggtggtgtttcaactaggaagggagaaaatgagtgcatctgaagttccttacagcttggtttctttggaatgctttcatcttctaagcaaagggatcagggtttgatctgtaagagttaaaaagacaaagtcattttgaagaattaactcagccagggatcatgcaaaaagattagaaaccataatgcccttgttaaagccctgctgtcaacctgccttcacccagagcttagagggccacagcagcaaagaggttggggtccatccctctctgatgtgctttttccacaacacatatctggtcctctggcaggattgtggatagagctcctcaccatacccaaaagactcagccccagtgccagtgctttcctggttcaacaacccaccacaaaaccttagtaaaaggatgagccaaaaatgaaaaagactcgactctacagtaagtcagtcagggatttcctttttaatggtttaagacatccaaatggcaagccaggaatagataccattaaagggtctcataggactaaccttaccagagccagaaatctagctctctggaagagatgcaagattctagaaaagtaaagggaagtgtcggcacatctaaatttagtgaacacaaaattaatttttatctagtctgtgacggagggaataaagtttttcatgtatcaaccacctcccccagtcaggtttctccctttttgagattatgaagaagctgagacatacttcttaaggaggtcgtgttttagaaggaaaaggcagaggctatccatcattatgctggctagatgcgcttctgaagaagccggattctgatgttcttaaccaaaatggtgaggtcatggaagtcccatttgcttggagattttgaaaaaaaaaaaaaaaaaaaacccattcccataaagtaattgagttcagcctttggattatttttggtttggtttttctctggttttgggtgtgatgtaagaagagctttttagttttgttttgaataacatcaatccttgcacactctatgcaaaaattttgtaagcatttcaataatgctatgaattacaaggaactattttaactttattacactttctgtataaaaaatttgtatttaatattatttcgaccacagtcttgtaaaatatattaataaaaataatgattggtaagaaggaaaaaaaaaaa

SEQ ID NO: 317634 - DNA, 4489 bp, Homo sapiens
gggaatatagttacttggcaaagtctttcaggaaggaagcccttccttatgttacatgtggaaagcctgccttccaagacatgtggaagtaattgatccacctgccagagaaacacaggctcagaggatgcctgggaacagggaggatgggattagtggaagcttaatggaaaaggaaagttatgatcctccaagacccttaattgatagaccataccaggttctgcaggtcagcatcattgtgtaatgagagtgaagtaggggaccctgtggttcaaccttagaatctgtttcctgtaggctctttctgctgtctatattcattaaagttttccacttcaccctcccatagtctagagggatgcccattccatggtcctccagagaatagttttgacttaacatgtctgtttagcccacatcacgtcagttatcaacaccgccactgtgcttactgttcctacagccacaccaggcttgaagagttagtgagaccaacaaataattggaagtattggaaaaagcaaaatacatggggacaaaaaaaatacagtgaaattctttttatcaaactgatgctgtgagaaaccagatgaatgccagtttggctttatttctaagaatctgggtcttcattctctggtgtagaaggaatgcaaaaaactataacaacaacaacaaaaacatattttgaaaagacatattctgacatctctgcttgtgtgtggtaaggcaggttcctatcagacatttatccctttggtcaagatcccttttgctcatccagggtttcatactcaatatcgcttaaaaaaaaaaaagtatcagctagggatgactctggaagtatgagtatcatggtggggaggaaggaattttttttaaatgtaaatgacccccatttaccagaccctaatcaaagtcacttaagggaatccctcagccttttatttggaaacagttgaaataaactggcagcagctagatcagagtatcttgctttattttataaaggccaaaggtagtatgaagtttggaccaaaaaggtaaatagatccattccagcacctgatactgatttttcaaggctctatgaaaggtcaaaaatttcattaaacaagaccagttctccctcttccccctgtcccaagaaatcttaggcatgaaaaggataaggaaacagctcctggaatgatacatttgcatagtgccctagtagcaggttgggaaaaagttataatataagaaacaaccttcgaaaacaggccttttatctcaaagataaaatgtctttcttgtggtctttcatcactatctccgtggtggaaggttcccctagttccaacatatttccattaaaatagtcaaagccacggcattgggatgtcagatgcctctctttctttgtggtaatcggaatttaaaattatacagttgcctctgaatttctcatgcacaaagccaaaccactgataagagataaagcagtctgaagcctgctgcttcagccagcacagcacaccacacacgctcgcactttcaaaagcaatgtgatttctatggttcttaaaagctttcttcataagggagtccctgaaatttctcaaggcaggtttgaatggcaaagggaaaataattacttgtgggaggtcctccttttgagtattgttagagcatacatgtaaaagaaaataacctttttggggcaactcatgctcacacatgctgttttctttggttctccccctaccttccttttgtagatattgacagaataggaggaaatgagcatccttatttgagaaagagcaagaatgtcatgagcccttgatgcaatagtaagtgtgatgtcatcatacagtgttaatgatgctatcaaatccatcaataaacagtctcaaaccttccaacaacagtgctcactgctgctcctcaacttcagcccagcaagcagtaatatcatcacccattttgagatatgcaggtggaatagaacaaagaaacagccactgtaatcgagaagcatgtttactgtctaaatccacctgttgcagtaggaagccagagtggggttccaaatgcctcattaagtatgtggacagcctcactagtaagtgagtgaatttggcttcatcactgaacattagctaaggtcagcttaataacacaaatatgaggccgacttctttgcgagaagagaaaagaaaacatctgcttgatttaaaatccaccccacatgcctagagttgtctaatagtccctcactttccaatggcttcacatcctacttctacatttggggttttttggtgaaatcagagatagctcaggatttcataaaacgagaaactccaaactggtctattaggttccatgggaacacttgtagccaaaggattgtctgagggcaggaagacgacacttgtcaacaaggaagacagtgtttctttaggtcccatattcatctaattcatggggttctaacattttggggggccatagatctttgacaatctgagccatctatgaaactctccccaaaagaaccaccccacaaaatcttgcaaaacgtaagagattttcctggatctgaagctacccgaagacatgggaagagttgtattctattattcaattttaagaatatttattaatattcactgagctattgctagccactgtgctaaacattttacatacattctcctatttcatcctcaaaacaatcctttgagttgggttttaatatagttccaatattcggatgtgaaaactgaggcttatagtggctaagaaacttgcccaaagccactacctagaaaatggcagagctggaatgtaggtttaactcctgaccactatgctataaagtcaccacatgtcaaactaattttcaagttgttgggacatgtcccctactaggttttaaactagatcttccttggtagatgaagctatagaacttctattttccctgctttctgtagtctctcacagtgacagcatctatactaaagtatagatacctaaggggaaaatatagaaagcctgcctgaataatagaatctagaacaacaacaaaaatattaattttttctgtgtatgcttaggtcaagcttaaaaaaaaaaaaaaaagaccggaaaatacctgggttgttagcctcacatttaggaaaaaattgtaatactcaattatctgtgtgtgtggctaaacaagtcagcatttctgcacacatacatctctttcctttatacttcccttcaaaagacaaatatcttacttttgatctttgacactatttggtcagtattcttctttacctttacttgtggcaaaactcaaggaagcgatcaaatagagggaagctcatttctatcattgtctctgtttccctataagaaagaactaccagggactcactgactgcattaggcatacaatgtcagagctgagctgaccactctggtcctgtaatgtctttggcctcacaccttggcagccatcattaatgggccatacccttccccaggtgcagaattctcctccccagagcactcaggccgttactaccaatttatctgagttggaaataagactcatttgccagttcttatttttaaagtggcaccctttaactttgaacctgtgtattttacactggcatccctggttcaacaacccaccacaaaaccttagtaaaaggatgagccaaaaatgaaaaagactcgactctacagtaagtcagtcagggatttcctttttaatggtttaagacatccaaatggcaagccaggaatagataccattaaagggtctcataggactaaccttaccagagccagaaatctagctctctggaagagatgcaagattctagaaaagtaaagggaagtgtcggcacatctaaatttagtgaacacaaaattaatttttatctagtctgtgacggagggaataaagtttttcatgtatcaaccacctcccccagtcaggtttctccctttttgagattatgaagaagctgagacatacttcttaaggaggtcgtgttttagaaggaaaaggcagaggctatccatcattatgctggctagatgcgcttctgaagaagccggattctgatgttcttaaccaaaatggtgaggtcatggaagtcccatttgcttggagattttgaaaaaaaaaaaaaaaaaaaacccattcccataaagtaattgagttcagcctttggattatttttggtttggtttttctctggttttgggtgtgatgtaagaagagctttttagttttgttttgaataacatcaatccttgcacactctatgcaaaaattttgtaagcatttcaataatgctatgaattacaaggaactattttaactttattacactttctgtataaaaaatttgtatttaatattatttcgaccacagtcttgtaaaatatattaataaaaataatgattggtaagaaggaaaaaaaaaaa

SEQ ID NO: 317635 - DNA, 1909 bp, Homo sapiens
gggaatatagttacttggcaaagtctttcaggaaggaagcccttccttatgttacatgtggaaagcctgccttccaagacatgtggaagtaattgatccacctgccagagaaacacaggctcagaggatgcctgggaacagggaggatgggattagtggaagcttaatggaaaaggaaagttatgatcctccaagacccttaattgatagaccataccaggttctgcaggtcagcatcattgtgtaatgagagtgaagtaggggaccctgtggttcaaccttagaatctgtttcctgtaggctctttctgctgtctatattcattaaagttttccacttcaccctcccatagtctagagggatgcccattccatggtcctccagagaatagttttgacttaacatgtctgtttagcccacatcacgtcagttatcaacaccgccactgtgcttactgttcctacagccacaccaggcttgaagagttagtgagaccaacaaataattggaagtattggaaaaagcaaaatacatggggacaaaaaaaatacagtgaaattctttttatcaaactgatgctgtgagaaaccagatgaatgccagtttggctttatttctaagaatctgggtcttcattctctggtgtagaaggaatgcaaaaaactataacaacaacaacaaaaacatattttgaaaagacatattctgacatctctgcttgtgtgtggtaaggcaggttcctatcagacatttatccctttggtcaagatcccttttgctcatccagggtttcatactcaatatcgcttaaaaaaaaaaaagtatcagctagggatgactctggaagtatgagtatcatggtggggaggaaggaattttttttaaatgtaaatgacccccatttaccagaccctaatcaaagtcacttaagggaatccctcagccttttatttggaaacagttgaaataaactggcagcagctagatcagagtatcttgctttattttataaaggccaaaggtagtatgaagtttggaccaaaaaggtaaatagatccattccagcacctgatactgatttttcaaggctctatgaaaggtcaaaaatttcattaaacaagaccagttctccctcttccccctgtcccaagaaatcttaggcatgaaaaggataaggaaacagctcctggaatgatacatttgcatagtgccctagtagcaggttgggaaaaagttataatataagaaacaaccttcgaaaacaggccttttatctcaaagataaaatgtctttcttgtggtctttcatcactatctccgtggtggaaggttcccctagttccaacatatttccattaaaatagtcaaagccacggcattgggatgtcagatgcctctctttctttgtggtaatcggaatttaaaattatacagttgcctctgaatttctcatgcacaaagccaaaccactgataagagataaagcagtctgaagcctgctgcttcagccagcacagcacaccacacacgctcgcactttcaaaagcaatgtgatttctatggttcttaaaagctttcttcataagggagtccctgaaatttctcaaggcaggtttgaatggcaaagggaaaataattacttgtgggaggtcctccttttgagtattgttagagcatacatgtaaaagaaaataacctttttggggcaactcatgctcacacatgctgttttctttggttctccccctaccttccttttgtagatattgacagaataggaggaaatgagcatccttatttgagaaagagcaagaatgtcatgagcccttgatgcaatagtaagtgtgatgtcatcatacagtgttaatgatgctatcaaatccatcaataaacagtctcaaaccttcca

SEQ ID NO: 317636 - DNA, 261 bp, Homo sapiens
agtaagcttacatttctgtgtaggtttgggaatatagttacttggcaaagtctttcaggaaggaagcccttccttatgttacatgtggaaagcctgccttccaagacatgtggaagtaattgatccacctgccagagaaacacaggctcagaggatgcctgggaacagggaggatgggattagtggaagcttaatggaaaaggaaagttatgatcctccaagacccttaattgatagaccataccaggttctgcaggtcag

SEQ ID NO: 317637 - DNA, 2307 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317638 - DNA, 431 bp, Homo sapiens
cgacggggtgctccacccgacggggtgctccacccgacggggtgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccacccccgtcgggtggagcggggaatctctgttcatcaaattctcatgttatgttgagtatcatttaacatttcaaaaaattcacagctgtcttatttttttaaaatcttacttatgtagctcagttaatcttaactatcatatttattatcttacccccagagc

SEQ ID NO: 317639 - DNA, 578 bp, Homo sapiens
cgacggggtgctccacccgacggggtgctccacccgacggggtgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccacccccgtcgggtggaggctccacccgacggggtggggctagatctggtctagagaggcgactccaagctctcttgctggctcccagctgtgggaatcctttaggcttgttctcaacctacacgttaaaaatgcttcttggtgtgtttggggagggggagagggaaactgagctctctcttgacctcctccaacacccttgacttgcttacccagccattttcagtagctacacgggtggtcacagaacactgggcggcactcggcacacaacacagaaccggggcagtccatgcaggtgcgggaacacat

SEQ ID NO: 317640 - DNA, 302 bp, Homo sapiens
tgatcgagctcggtccgctctccgacggggtgcctgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccacccccgtcgggtggagcaccccgtcggaagagcgggcgagct

SEQ ID NO: 317641 - DNA, 223 bp, Homo sapiens
ttagaggatccttaccgactagcccgacaggccccgactagccctgacagccccgactagcccgaccacagcgtcagctcctacctctgaccccagcttctctctggttcccacaggccccatgcatcctccctgcctcactcccctcagcccctgccgaccttagcttatctgggagagaaacagccccatgcatcctccggcctcactcccctcagcacct

SEQ ID NO: 317642 - DNA, 2264 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317643 - DNA, 1955 bp, Homo sapiens
gctgcagttgtcgtgacaggtcagatctttcggccggacaacttcgtgtttgccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317644 - DNA, 2252 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccacccccgtcgggtggagcggggaatctctgttcatcaaattctcatgttatgttgagtatcatttaacatttcaaaaaattcacagctgtcttatttttttaaaatcttacttatgtagctcagttaatcttaactatcatatttattatcttacccccagagc

SEQ ID NO: 317645 - DNA, 2399 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccacccccgtcgggtggaggctccacccgacggggtggggctagatctggtctagagaggcgactccaagctctcttgctggctcccagctgtgggaatcctttaggcttgttctcaacctacacgttaaaaatgcttcttggtgtgtttggggagggggagagggaaactgagctctctcttgacctcctccaacacccttgacttgcttacccagccattttcagtagctacacgggtggtcacagaacactgggcggcactcggcacacaacacagaaccggggcagtccatgcaggtgcgggaacacat

SEQ ID NO: 317646 - DNA, 2052 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcaaaagaaaattagagctgatcctctagagtcga

SEQ ID NO: 317647 - DNA, 1587 bp, Homo sapiens
gatgctgaggtgatctagaggatcccgacgcatcaacgccgcctgttcgacaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317648 - DNA, 1613 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtga

SEQ ID NO: 317649 - DNA, 1664 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaaaaattttttaatgtcgatcggccttttatttagtagtagtaggc

SEQ ID NO: 317650 - DNA, 770 bp, Homo sapiens
cgccgtctctccgcctcctcctcgaactcgccctcctcggccgtgacaatgcgttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317651 - DNA, 680 bp, Homo sapiens
tctcattgtaaaatgggctcctgactcagtttcttgcctctcttcccagagatattctctatttatatagaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317652 - DNA, 891 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctacgttctattgcctggggggatcatctagtgtgctactgcaggctt

SEQ ID NO: 317653 - DNA, 478 bp, Homo sapiens
tgatcgagctcggtccgctctccgacggggtgcctgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317654 - DNA, 807 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctctggtaaaccacccacgtggaactttgtaaactggtg

SEQ ID NO: 317655 - DNA, 816 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcagctgggcaggctgggccgtgagcggggtctcctcactcaccttt

SEQ ID NO: 317656 - DNA, 279 bp, Homo sapiens
ttagaggatccttaccgactagcccgacaggccccgactagccctgacagccccgactagcccgaccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317657 - DNA, 570 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcccacaccaatttttgacactgtattaatcacaaacatgaaatagaccccacactcacatagcatgtagacagttgcgttcaactactgagtatcaacgtgtactacaaccaggacac

SEQ ID NO: 317658 - DNA, 2462 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatggaagacaagagagaaccctcagagggatacatctaacagcggccgaccaaaaaaaaacaaacaaaaaacaacaacagacaccccagaaacccagaacaaaacaaccacaacacaaacaaggcgaccgaaaacacgcacaagcaacccgacaaagaca

SEQ ID NO: 317659 - DNA, 2395 bp, Homo sapiens
cagtgtgctgtggcgatctagaggtcccctcggtctaccttccaagggtcctactgaatatgagacagttcaagaatactagggaaaaaaattctagtaattgaagtaacggtcatctaaggataatatgccacatatacagacacagtaatattttcaacttaaaaaaaattcagttgtcaaagctgtacagcaaacactatcctaagctgggcctcttcaggcattggctttataatcacttcaaagaaaagtcaattacaaaatgccacatttggtatgattctatttatatgaaatgtccaggataggcaaatctacagagacagaaattagatcagaggtcgccaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317660 - DNA, 2152 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317661 - DNA, 1972 bp, Homo sapiens
cctcatggctgactctagaggatacacagccttaccgtcgggaacgaaagctgagggtgttgagccaaatagttctaagcttcagctaaacttatttagactacgaccttatgtggctgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317662 - DNA, 2230 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317663 - DNA, 1515 bp, Homo sapiens
  misc_feature (50)..(50): n is a, c, g, or t
catccccgtgtcttgtcttgtgaatggatttgtccacatccagctccgtnccagcgcttcccgggccagctgaacgccgacctgcgcaagctggccgtcaacatggtcccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317664 - DNA, 1058 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317665 - DNA, 768 bp, Homo sapiens
gagacggagtctcgctctgttgcccaggctgcagtgcagtggcacaatgtcggctcactgcaagttccgcctcctgggttcacgccattctcctgcctcagcctcccgagtagctaggactacaggcgcccgccaccactcccggctaattttttttgaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317666 - DNA, 640 bp, Homo sapiens
ctcacccgacggggtgggggttggggtattcggttttcctcttccatttcttcactggaaggagatgagaggcgtgagataaaagagtcaaaagttccttgagaactggaacattccagaagagaagtgtctgatggtctgagagggtgcatgctttttaggggacccgcatctgtatttccagtttattctgaagagtccagccaaatagaaccactccccgtttcctgtccttcacaggcttccctgtcgctacacctctgtggtttcttctacccagaatatacctgtcacgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctggttcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 317667 - DNA, 797 bp, Homo sapiens
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacccccccatctctgaaccctagagccccgctttccctccaaggctgactcccccctgaccctaacaatacctttggagctcgctttacctctggctacttcatctccgaccctggctcccctttgagccctaatttatctttaacccccttgagctcttccaaccttgacattcccaggaggagccccgcttcaccccttctcactctggaaaccgcacctttaactttgcagaccttccttcacccctgacttctgcttcacctttgacctctgccccccatgaatcccattttacctctagacctataagttctggtttatgtttgacccctccctctgagcttgcacttcaccgctgaccttgcctcacctttaaccccccacctgagccccagctcctacctctgaccccaacttctctttgatctctgaatcccctctcctttggactttcaaactttttttttttataaaccactttttattaagatcgcccaattttgtacctttggtaacaacctcgccc

SEQ ID NO: 317668 - DNA, 797 bp, Homo sapiens
agtatatatggtctcctgaaggacattgtctcaaccctgcaaggtgttgcgaccgagctggcactgtaactagatcttcaaaaggccattccgcctttctatcaagccagctgcttcggtatgatggagaacatggtaagccatgagcacgggcccattgctgtacttcacttgctgtgaaatgagtttattcatcaaaagcactgctgtgtggaaaaagtggtggtggataaggcattctggaagtccatagatgatagttttggcagagcattaaatgcagggaaagtaaatccaaatctagactgtctgttccagtaagaacaaagtgttgccctttcatgatggaaggagtccaatcaacctgccacaaggtggctggctgatcaccccagggaatgttgctgcagctcagtattggtgtctgctgctggcagattggcagattgggcactcagcagtggctgtactcagactggccttagtgagtggaagtccatgttgctgagcacctgaataccttccatccctgccaccatgtccacttttccagattcctatagaaatgaaattgtacagtaggtaattctttggggctttggtttttttttcactcagcataattattttgagattcatccatgttgtttttctgtgtatcatagttcctttttaaaattgctgagtagtattcaattgtatggatatactaaagtatatttgttcctcaattaaaggacatttgggtttccattttggcaattatgaataaagctgctataaacatttacatacag

SEQ ID NO: 317669 - DNA, 758 bp, Homo sapiens
agtatatatggtctcctgaaggacattgtctcaaccctgcaaggtgttgcgaccgagctggcactgtaactagatcttcaaaaggccattccgcctttctatcaagccagctgcttcggtatgatggagaacatggtaagccatgagcacgggcccattgctgtacttcacttgctgtgaaatgagtttattcatcaaaagcactgctgtgtggaaaaagtggtggtggataaggcattctggaagtccatagatgatagttttggcagagcattaaatgcagggaaagtaaatccaaatctagactgtctgttccagtaagaacaaagtgttgccctttcatgatggaaggagtccaatcaacctgccacaaggtggctggctgatcaccccagggaatgttgctgcagctcagtattggtgtctgctgctggcagattggcagattgggcactcagcagtggctgtactcagactggccttagtgagtggaagtccatgttgctgagcacctgaataccttccatccctgccaccatgtccacttttccagattcctatagaaatgaaattgtacagtaggtaattctttggggctttggtttttttttcactcagcataattattttgagattcatccatgttgtttttctgtgtatcatagttcctttttaaaattggtagttcaatgtgtgttagattggatgaatgaagaggtctatgcacattttgctgcggttgaaagttctaccacagg

SEQ ID NO: 317670 - DNA, 636 bp, Homo sapiens
  misc_feature (22)..(22): n is a, c, g, or t
  misc_feature (25)..(25): n is a, c, g, or t
actcacgcgtccggcatgcggnggntcagcagcccatccccacccgggtctgcaaggtcagtgaccttcatgaaggccacttctatgagttccgtgcccgggctgccaactgggcaggtgttggcgagctgtcggcacccagcagcctgtttgagtgcaaagagtggacaatgccccagccaggccccccgtacgatgtacgggcatccgaggtgcgggccacatccctggtgctgcagtgggaacccccactgtatatgggggctgggcctgtcacaggctatcacgtcagtttccaggaggaaggctctgagcagtggaagccggtcaccccaggccccatctctggcacccacctgagggtttccgacttgcagccaggaaagagttacgtgttccaggtacaggccatgaattcagctggtctggggcaaccgtccatgcccactgatcccgtgctcctggaggacaagccaggtgcccatgagatcgaggttggtgtggatgaagagggctttatctatttggcttttgaagcccctgaagcccccgactcctcagagtttcagtggtccaaagactacaagggcccactggacccccagagggtcaagatcgaggataaagttaacaagt

SEQ ID NO: 317671 - DNA, 2900 bp, Homo sapiens
atgacagcggctccggcgtctccgcagcagatcagggaccggctgctgcaggccatcgacccccagagcaacatccggaacatggtggcggtgctggaagtcatctccagcctggagaaataccctattaccaaagaggcacttgaggaaacacgacttgggaagctcatcaacgacgtccgcaagaaaaccaagaacgaggagctcgccaagcgggccaagaagctgctgcggagctggcagaagctcatcgagccggcacaccagcatgaggcggcgctgcgggggctggcgggggccaccggctctgccaacgggggcgcacacaactgccggccggaggtgggggcggctggcccacccaggagcatccatgacctgaagagccgcaatgacctccagaggctgcccgggcagcggctggacaggctgggcagccgcaagcgccggggtgaccagcgtgacctcggccacccagggccgccacccaaggtctccaaagctagccacgaccccctggtccccaactcatcccccctccccaccaacgggatcagtgggagtccagagagcttcgccagctccctggatggcagtgggcatgcaggcccagagggcagccgcctggagcgtgacgagaatgacaagcacagtggcaagatccccgtcaacgccgtgcgaccgcacaccagctccccgggcctgggcaagccccctggaccctgcttgcagccaaaggcttcggtgctgcagcagctggacagggtggacgagactccggggcctccccatcccaagggaccccctcgctgctctttcagtcctcggaactcacggcatgagggctcctttgcccggcagcagagcttgtatgcacccaagggctccgtgcccagcccctcaccgcggccccaggcactcgatgccacacaggtgccgtcaccgcttccactggcacagccgtccacaccccccgtacggcggctcgagctgctgcccagtgcggaaagcccagtgtgctggcttgagcagcctgagagccaccagcggctggcggggccgggctgcaaggcagggctgtccccagccgagcccctcctgtcccgggcaggcttttccccagactcctccaaggcggacagtgatgctgcctcctcagggggctcggacagtaaaaagaagaagaggtaccgacctcgagactatacggttaacttggacgggcaggtggctgaggcgggcgtcaagcctgtccggttaaaagagcggaagctcacctttgaccccatgacgagacagatcaaacctctgacccagaaagagccagtgcgggcagacagccctgtgcacatggagcagcagtccaggacagagctggacaagcaggaggccaaggccagcctccagagccccttcgaacagacgaactggaaggagctgtcacgcaacgagatcatccagtcctacctgagccggcagagcagcctgctctcatcatcgggcgcgcagaccccaggggctcaccacttcatgtctgagtacctgaagcaggaggagagcacccggcaaggggccaggcagctgcatgtgctggtgcctcaaagcccgcccacggacctccctggtctgacccgggaggtcacacaggacgatctcgacagaatccaggccagccagtggccgggggtgaacgggtgtcaggacacacagggtaactggtatgactggacgcagtgcatatcgctcgatccgcacggcgacgacgggcgcttgaacattctgccttatgtctgcttggactgaccggcctgtcagccacaaagtgcattcccatcttgcagaagccgggtgggcgggcaggcaggtgggcaggtggcggggcccagctgcctcctgcgctgggaactcggggagtccggcccaggcgggagggagggggcgggagtcacgcggtctctctgcgctcttccctcaaaactctttatgtgaaatgctgctaccagtttactaacaaaattgcgaagaaggaccgcgtggaaggaaggacggcaaagtgagttcagaactctatagcaaaccagctataaaaagcgttagtccctcacccccaaagaggtgcggacactttccagcacctgaaagctggggcctcagttgcaggcaggcacagaaaacctgtgggagaggtcacctttaacacagcaacagaagcacgcatctcatctctcttgcattttctgttctttaatttggccctgagtgtcttgagacagtgggccatgccactgcctctgtttgctccctacccagccactgtcaggccagtgttgtctgtcatgtgccagaagcttctcagctgtggtgagccactggcattgggcaggcgggccagctggccagccagtgtgacccacactccatgggcagccacctgtttatatctggtttcagttataacccagtttttaaagaaatgctgcaaaaatttaagttttctcatgtttattttaaacaattcctcttccatcagaccaccagacaaaaaaacctttcctttcttcctcccttttcttttttcccttcctgtacacatctagaaaacttcacctttctagagtccccccaaaacaacacaaaagttattgtgggtgctactggttttatgctgtactgtggggcgagggggaagacctgtctgtacgctggaaacactcataaccattcctttagattcgtttgccttatggttatttgtcataaacgcgatttgcaaaaacaaggagccttagtgaatgtacagtacctagacttctgtgttctcaggacgcagaagggagcaactttgctatttggtccagtaagtggacaccttgtgatataaatgtggaaataaaaaaaaa

SEQ ID NO: 317672 - DNA, 3369 bp, Homo sapiens
atcacggggttctctgccggtgggggggcggggggactgtgcccccacaagggacggcggcaatgactgcagattgggggagggggcgcttcggaggccagagatgccgctcaacttccgacagatcgggggacccgccccgaagacagagcgatcccgcccaaatgccagtggtgccgaggtggagaagccgccgcgtagacgcagatttgcaacctccggctttcccagctacggcgggcggcttctgccagaggcgctttgccgcctcacgttttcgcgatcggggtcgcgcgtggcggtgcagacccccgccctgccaccacacccattcccacaccctctgaggggcgggggggccgcggcgacacccccggactccgatgacccttctgcgcgcagaatcacaacgtggacgtctggttccctcgccctcacaaaaaactcggcagctgctcagcctgcgactcccgtcccccagtcacgcgccgggaaggctctcccagaggaaggattttcccgccgccctccccgccccgagatccggaacatggtggcggtgctggaagtcatctccagcctggagaaataccctattaccaaagaggcacttgaggaaacacgacttgggaagctcatcaacgacgtccgcaagaaaaccaagaacgaggagctcgccaagcgggccaagaagctgctgcggagctggcagaagctcatcgagccggcacaccagcatgaggcggcgctgcgggggctggcgggggccaccggctctgccaacgggggcgcacacaactgccggccggaggtgggggcggctggcccacccaggagcatccatgacctgaagagccgcaatgacctccagaggctgcccgggcagcggctggacaggctgggcagccgcaagcgccggggtgaccagcgtgacctcggccacccagggccgccacccaaggtctccaaagctagccacgaccccctggtccccaactcatcccccctccccaccaacgggatcagtgggagtccagagagcttcgccagctccctggatggcagtgggcatgcaggcccagagggcagccgcctggagcgtgacgagaatgacaagcacagtggcaagatccccgtcaacgccgtgcgaccgcacaccagctccccgggcctgggcaagccccctggaccctgcttgcagccaaaggcttcggtgctgcagcagctggacagggtggacgagactccggggcctccccatcccaagggaccccctcgctgctctttcagtcctcggaactcacggcatgagggctcctttgcccggcagcagagcttgtatgcacccaagggctccgtgcccagcccctcaccgcggccccaggcactcgatgccacacaggtgccgtcaccgcttccactggcacagccgtccacaccccccgtacggcggctcgagctgctgcccagtgcggaaagcccagtgtgctggcttgagcagcctgagagccaccagcggctggcggggccgggctgcaaggcagggctgtccccagccgagcccctcctgtcccgggcaggcttttccccagactcctccaaggcggacagtgatgctgcctcctcagggggctcggacagtaaaaagaagaagaggtaccgacctcgagactatacggttaacttggacgggcaggtggctgaggcgggcgtcaagcctgtccggttaaaagagcggaagctcacctttgaccccatgacgagacagatcaaacctctgacccagaaagagccagtgcgggcagacagccctgtgcacatggagcagcagtccaggacagagctggacaagcaggaggccaaggccagcctccagagccccttcgaacagacgaactggaaggagctgtcacgcaacgagatcatccagtcctacctgagccggcagagcagcctgctctcatcatcgggcgcgcagaccccaggggctcaccacttcatgtctgagtacctgaagcaggaggagagcacccggcaaggggccaggcagctgcatgtgctggtgcctcaaagcccgcccacggacctccctggtctgacccgggaggtcacacaggacgatctcgacagaatccaggccagccagtggccgggggtgaacgggtgtcaggacacacagggtaactggtatgactggacgcagtgcatatcgctcgatccgcacggcgacgacgggcgcttgaacattctgccttatgtctgcttggactgaccggcctgtcagccacaaagtgcattcccatcttgcagaagccgggtgggcgggcaggcaggtgggcaggtggcggggcccagctgcctcctgcgctgggaactcggggagtccggcccaggcgggagggagggggcgggagtcacgcggtctctctgcgctcttccctcaaaactctttatgtgaaatgctgctaccagtttactaacaaaattgcgaagaaggaccgcgtggaaggaaggacggcaaagtgagttcagaactctatagcaaaccagctataaaaagcgttagtccctcacccccaaagaggtgcggacactttccagcacctgaaagctggggcctcagttgcaggcaggcacagaaaacctgtgggagaggtcacctttaacacagcaacagaagcacgcatctcatctctcttgcattttctgttctttaatttggccctgagtgtcttgagacagtgggccatgccactgcctctgtttgctccctacccagccactgtcaggccagtgttgtctgtcatgtgccagaagcttctcagctgtggtgagccactggcattgggcaggcgggccagctggccagccagtgtgacccacactccatgggcagccacctgtttatatctggtttcagttataacccagtttttaaagaaatgctgcaaaaatttaagttttctcatgtttattttaaacaattcctcttccatcagaccaccagacaaaaaaacctttcctttcttcctcccttttcttttttcccttcctgtacacatctagaaaacttcacctttctagagtccccccaaaacaacacaaaagttattgtgggtgctactggttttatgctgtactgtggggcgagggggaagacctgtctgtacgctggaaacactcataaccattcctttagattcgtttgccttatggttatttgtcataaacgcgatttgcaaaaacaaggagccttagtgaatgtacagtacctagacttctgtgttctcaggacgcagaagggagcaactttgctatttggtccagtaagtggacaccttgtgatataaatgtggaaataaaaaaaaa

SEQ ID NO: 317673 - DNA, 2857 bp, Homo sapiens
atgacagcggctccggcgtctccgcagcagatcagggaccggctgctgcaggccatcgacccccagagcaacatccggaacatggtggcggtgctggaagtcatctccagcctggagaaataccctattaccaaagaggcacttgaggaaacacgacttgggaagctcatcaacgacgtccgcaagaaaaccaagaacgaggagctcgccaagcgggccaagaagctgctgcggagctggcagaagctcatcgagccggcacaccagcatgaggcggcgctgcgggggctggcgggggccaccggctctgccaacgggggcgcacacaactgccggccggaggtgggggcggctggcccacccaggagcatccatgacctgaagagccgcaatgacctccagaggctgcccgggcagcggctggacaggctgggcagccgcaagcgccggggtgaccagcgtgacctcggccacccagggccgccacccaaggtctccaaagctagccacgaccccctggtccccaactcatcccccctccccaccaacgggatcagtgggagtccagagagcttcgccagctccctggatggcagtgggcatgcaggcccagagggcagccgcctggagcgtgacgagaatgacaagcacagtggcaagatccccgtcaacgccgtgcgaccgcacaccagctccccgggcctgggcaagccccctggaccctgcttgcagccaaaggcttcggtgctgcagcagctggacagggtggacgagactccggggcctccccatcccaagggaccccctcgctgctctttcagtcctcggaactcacggcatgagggctcctttgcccggcagcagagcttgtatgcacccaagggctccgtgcccagcccctcaccgcggccccaggcactcgatgccacacaggtgccgtcaccgcttccactggcacagccgtccacaccccccgtacggcggctcgagctgctgcccagtgcggaaagcccagtgtgctggcttgagcagcctgagagccaccagcggctggcggggccgggctgcaaggcagggctgtccccagccgagcccctcctgtcccgggcaggcttttccccagactcctccaaggcggacagtgatgctgcctcctcagggggctcggacagtaaaaagaagaagaggtaccgacctcgagactatacggttaacttggacgggcaggtggctgaggcgggcgtcaagcctgtccggttaaaagagcggaagctcacctttgaccccatgacgagacagatcaaacctctgacccagaaagagccagtgcgggcagacagccctgtgcacatggagcagcagtccaggacagagctggacaagcaggaggccaaggccagcctccagagccccttcgaacagacgaactggaaggagctgtcacgcaacgagatcatccagtcctacctgagccggcagagcagcctgctctcatcatcgggcgcgcagaccccaggggctcaccacttcatgtctgagtacctgaagcaggaggagagcacccggcaaggggccaggcagctgcatgtgctggtgcctcaaagcccgcccacggacctccctggtctgacccgggaggtcacacaggacgatctcgacagaatccaggccagccagtggccgggggtgaacgggtgtcaggacacacagggtaactggtatgactggacgcagtgcatatcgctcgatccgcacggcgacgacgggcgcttgaacattctgccttatgtctgcttggactgaccggcctgtcagccacaaagtgcattcccatcttgcagaagccgggtgggcgggcaggcaggtgggcaggtggcggggcccagctgcctcctgcgctgggaactcggggagtccggcccaggcgggagggagggggcgggagtcacgcggtctctctgcgctcttccctcaaaactctttatgtgaaatgctgctaccagtttactaacaaaattgcgaagaaggaccgcgtggaaggaaggacggcaaagtgagttcagaactctatagcaaaccagctataaaaagcgttagtccctcacccccaaagaggtgcggacactttccagcacctgaaagctggggcctcagttgcaggcaggcacagaaaacctgtgggagaggtcacctttaacacagcaacagaagcacgcatctcatctctcttgcattttctgttctttaatttggccctgagtgtcttgagacagtgggccatgccactgcctctgtttgctccctacccagccactgtcaggccagtgttgtctgtcatgtgccagaagcttctcagctgtggtgagccactggcattgggcaggcgggccagctggccagccagtgtgacccacactccatgggcagccacctgtttatatctggtttcagttataacccagtttttaaagaaatgctgcaaaaatttaagttttctcatgtttattttaaacaattcctcccttttcttttttcccttcctgtacacatctagaaaacttcacctttctagagtccccccaaaacaacacaaaagttattgtgggtgctactggttttatgctgtactgtggggcgagggggaagacctgtctgtacgctggaaacactcataaccattcctttagattcgtttgccttatggttatttgtcataaacgcgatttgcaaaaacaaggagccttagtgaatgtacagtacctagacttctgtgttctcaggacgcagaagggagcaactttgctatttggtccagtaagtggacaccttgtgatataaatgtggaaataaaaaaaaa

SEQ ID NO: 317674 - DNA, 740 bp, Homo sapiens
caagcccttaataaatgctttgatgtaatgttccttttgttcacagtacagttatgtagtgctagccagatatttaaaaatgctctaagaaaagcttgtcaggggggagggggaaatgtttttcttgtgataaatgaactttggtttaccaagggtattttgcatgatgctgctgctattttaacttttcagttgttttttctcttactgtagagtgtagtcattgaaaagttaactgagtgatattgttatgtaagaatctgaaccttgcagtgtaaatgcacttaagtcatctttaaaatgttgttaaactactctgaatatactgtgcaatgtaaatgctgaatgattggggttagataaatggtgaaatgagaattaatgaattttatacagattcatgctttcgcctgataacctatgtacagatattttaagtacataaatcagatttgacacatttattttttgaaaagtacatatatgttctcaatgaagattcatcctaggtttcctctttgttcgtttcaatagtagcacatacaatccaaaagttcctgctactgctgcttttgcccttccattttaaatggtatgatcgtttggccaaaatttccatgcaagttgataagggttttacaataatctgaacaaataggaaaccttgaatctctatgtatgcacatgaatacttgattgtgaataataaaagttgttttttatacagcctcattggtgaa

SEQ ID NO: 317675 - DNA, 2536 bp, Homo sapiens
ccaccagtgccatcttcccgaaaacccccttcttgaagtatctcccccataccccttcggctcaaaaactcgtccaattcgcaggagtaatcagatttcattataacctattggcaccagatagttacgcaaaaattattttctggagcaaacagtatttgaagaaaaggtaaaaactatgaatgtgtaattctaagaatagttaataattttactgaaggctgaacgtatgtagatattttttatgataaaatgcagtttttctttttttggaacatgccaattactggtatgtgtatatgctggaaattttcttacatatcctttttaagtcaaagttattaacattatccagcatgctttaatatgctccacatatcaaagatataaccaataatttaacgtagcttaaaagataacatttgttttgtttttagctttgcatacatttgtaattccctcccaccaccaatataccttaggtaccatttgtgtacatttcaagattttttttttcaataaaaaggtggggggaaatggaatcactttgccaactattgttctaagagttgacatcagttaccatttctaatgcattgttgtgattttgtagtgtcattcataactggtattgacattttagaaaacaccaaagtgatttaaaatatatgtggggaaaaaaacttctcactctagtaacaatgttttaatcatgttgtttgttaaatatttaaaagttattgttcaatttttgctagactatcttaaatcatgatagtgttgggaagggggtatcaaaatataaaattgttagtttgtgtatataaacaatgcacattaaaacaattgaattgcttccagcatacaacaaactaccttaaaattatgttcaaaatctattaaatatattttcatggctaatgtcgagtatatgttttcatcaattacattgttattgtattaatcgcggttaaacttggcatctcttggcaggatcctatttaatttctgttgccatcaaaatatatttatatgcatgagttttgctataaacctttattttctgctataaagttatatattatgacaaccataaatgcaattacaaattgggtaagaacaagctgaataaaagttgttcccatgactaatattagtcttcatgcttttagcatattttttaagacagtaacactcatcccatcaaattattacattacatttagtatttttctgagttacattgacaagaacttaaattatagcctgttattaatattgatttccaacgactgaacagtacaacagatcaataaaaaagtttatacactgctttaactaatttttgttatactcatgtggcttagtgtagttagtcactaaaacagagttcaagtgagcttggcaatggtgttgagtaacaagaaagaattttgcattaatgatttctttttattttcctcatttaaacaaccagcattactgccaaacaccaaccgtggtccatatttgtaacaggtttttaacatgacatagttagcaagtttgattgaagagatttttaggtcctgggcctataagattttagtatgatcttttttcatgtttctaatgcttgaggtgttactgcttaacttgggaaaaaaaaaaacaaaaaacagtgttcctgccatttgtaagttttcctataatattccttttattaactttaaaactggacttatcgggttcaaataggcagtatcccttttaagtgacctttgcaacccaagtgttacttgcttatttgatgctctcttgtattttaaatctcatttaaatctttgtctgtgaccaacaaagcttaagattttgtcttcatttaaaactctgaatctattccattgatcatgttagacgttcaaatgtttaatggtatagtctgacctagtgaaacaaaatggatgttgttactttttttaaagaatagaatgaaataactatttcacttgcccaaaattttaaatattttttcatctaaacttgtattgtttcccatagcagaatgtcaatattcacagtacatttctgtaaagagcaaaccaatataatgttttgagtgttgaaaaaaattccagatttttgaagaattagacaactcttcatctaccttatttctagttcacacagttatctcaaattccactgaaactaatgggatactgtcttgtgtagatgccagttgagtttataatgtgacctagtaaagctgtcttttttgttgtgttgtatgagtgtcggatcatgcttttaggaatacttttattaaaatggtgtgcattcatgcaaaaggccaactggcttttgtgaacaatagatcttttctcccctttattttgttctcttgacacttttgtgaaaattacctagcctgataaaaacattttgtaaaaatttgtataatactgttataaaatatttataatcccagaaaatgttgtgttaaatcttgtgcaaaaacagtatattcagaataaaagtttatcatttaaagtca

SEQ ID NO: 317676 - DNA, 2477 bp, Homo sapiens
ccaccagtgccatcttcccgaaaacccccttcttgaagtatctcccccataccccttcggctcaaaaactcgtccaattcgcaggagtaatcagatttcattataacctattggcaccagatagttacgcaaaaattattttctggagcaaacagtatttgaagaaaaggtaaaaactatgaatgtgtaattctaagaatagttaataattttactgaaggctgaacgtatgtagatattttttatgataaaatgcagtttttctttttttggaacatgccaattactggtatgtgtatatgctggaaattttcttacatatcctttttaagtcaaagttattaacattatccagcatgctttaatatgctccacatatcaaagatataaccaataatttaacgtagcttaaaagataacatttgttttgtttttagctttgcatacatttgtaattcaataaaaaggtggggggaaatggaatcactttgccaactattgttctaagagttgacatcagttaccatttctaatgcattgttgtgattttgtagtgtcattcataactggtattgacattttagaaaacaccaaagtgatttaaaatatatgtggggaaaaaaacttctcactctagtaacaatgttttaatcatgttgtttgttaaatatttaaaagttattgttcaatttttgctagactatcttaaatcatgatagtgttgggaagggggtatcaaaatataaaattgttagtttgtgtatataaacaatgcacattaaaacaattgaattgcttccagcatacaacaaactaccttaaaattatgttcaaaatctattaaatatattttcatggctaatgtcgagtatatgttttcatcaattacattgttattgtattaatcgcggttaaacttggcatctcttggcaggatcctatttaatttctgttgccatcaaaatatatttatatgcatgagttttgctataaacctttattttctgctataaagttatatattatgacaaccataaatgcaattacaaattgggtaagaacaagctgaataaaagttgttcccatgactaatattagtcttcatgcttttagcatattttttaagacagtaacactcatcccatcaaattattacattacatttagtatttttctgagttacattgacaagaacttaaattatagcctgttattaatattgatttccaacgactgaacagtacaacagatcaataaaaaagtttatacactgctttaactaatttttgttatactcatgtggcttagtgtagttagtcactaaaacagagttcaagtgagcttggcaatggtgttgagtaacaagaaagaattttgcattaatgatttctttttattttcctcatttaaacaaccagcattactgccaaacaccaaccgtggtccatatttgtaacaggtttttaacatgacatagttagcaagtttgattgaagagatttttaggtcctgggcctataagattttagtatgatcttttttcatgtttctaatgcttgaggtgttactgcttaacttgggaaaaaaaaaaacaaaaaacagtgttcctgccatttgtaagttttcctataatattccttttattaactttaaaactggacttatcgggttcaaataggcagtatcccttttaagtgacctttgcaacccaagtgttacttgcttatttgatgctctcttgtattttaaatctcatttaaatctttgtctgtgaccaacaaagcttaagattttgtcttcatttaaaactctgaatctattccattgatcatgttagacgttcaaatgtttaatggtatagtctgacctagtgaaacaaaatggatgttgttactttttttaaagaatagaatgaaataactatttcacttgcccaaaattttaaatattttttcatctaaacttgtattgtttcccatagcagaatgtcaatattcacagtacatttctgtaaagagcaaaccaatataatgttttgagtgttgaaaaaaattccagatttttgaagaattagacaactcttcatctaccttatttctagttcacacagttatctcaaattccactgaaactaatgggatactgtcttgtgtagatgccagttgagtttataatgtgacctagtaaagctgtcttttttgttgtgttgtatgagtgtcggatcatgcttttaggaatacttttattaaaatggtgtgcattcatgcaaaaggccaactggcttttgtgaacaatagatcttttctcccctttattttgttctcttgacacttttgtgaaaattacctagcctgataaaaacattttgtaaaaatttgtataatactgttataaaatatttataatcccagaaaatgttgtgttaaatcttgtgcaaaaacagtatattcagaataaaagtttatcatttaaagtca

SEQ ID NO: 317677 - DNA, 1340 bp, Homo sapiens
gctggaagattatatctggatcaccaccagagcaagccctttctgaagcttcattccaagacccatgtgtagagatgccccctggggattcagaccacgggaccagtgaccttgagaagagcttcaatctgagaccagtcctctctccgcaacagagagtgcccgtggaagcgagacctcgcaaatgtgagacacacaccgagagcttcaagaactcggaaatcctgaaacctcacagagcaaaaccatatgcatgtaatgaatgtggcaaagccttcagttactgttcttccctttctcagcatcagaagagccacactggagagaagccctatgagtgcagtgaatgtgggaaggccttcagccagagctcatctctcattcagcaccagaggattcacactggagagaagccttacaagtgcagtgaatgtggaagagccttcagccagaacgccaacctcaccaaacaccagcgaacccacaccggagagaagccctacagatgcagcgagtgtgagaaagccttcagtgactgctcagctcttgttcagcatcagagaattcataccggagagaagccctacgaatgcagcgactgtgggaaggccttccgtcacagtgcaaacctcacgaaccatcagaggactcacaccggggagaagccctacaagtgcagcgagtgtgggaaggccttcagttactgcgcagcgttcattcagcaccagaggattcacaccggggagaagccctacagatgtgccgcgtgtgggaaggccttcagccagagtgcaaaccatcagaggactcacactggggagaaaccctacaagtgcagcgagtgtgggaaggccttcagccagagtaccaatctcataatccaccaaaagacccacaccggggagaagccatataaatgtaatgaatgtgggaaattcttcagtgagagctcagccctcattcggcatcatataatccacaccggagaaaaaccttatgagtgtaatgagtgtggtaaagcgtttaaccagagctcatcccttagtcagcatcagagaatccacacaggcgtgaaaccctacgaatgcagcgagtgtgggaaggccttccggtgcagctctgccttcgttagacatcagagactccacgccggagagtaactaggaacatggtagaagtggagagagtcccggacatgccgactcaggacaggtgggtgaggatctgagaaatgctaaaggcttgaaagcatctgaagacatctaacttagagtctgcagcccagagccacatgcaaaacaccttcaataaacagccactatttcacatgctgtaatgga

SEQ ID NO: 317678 - DNA, 1286 bp, Homo sapiens
gctggaagattatatctggatcaccaccagagcaagccctttctgaagcttcattccaagacccatgtgtagagatgccccctggggattcagaccacgggaccagtgaccttgagaagagcttcaatctgagaccagtcctctctccgcaacagagagtgcccgtggaagcgagacctcgcaaatgtgagacacacaccgagagcttcaagaactcggaaatcctgaaacctcacagagcaaaaccatatgcatgtaatgaatgtggcaaagccttcagttactgttcttccctttctcagcatcagaagagccacactggagagaagccctatgagtgcagtgaatgtgggaaggccttcagccagagctcatctctcattcagcaccagaggattcacactggagagaagccttacaagtgcagtgaatgtggaagagccttcagccagaacgccaacctcaccaaacaccagcgaacccacaccggagagaagccctacagatgcagcgagtgtgagaaagccttcagtgactgctcagctcttgttcagcatcagagaattcataccggagagaagccctacgaatgcagcgactgtgggaaggccttccgtcacagtgcaaacctcacgaaccatcagaggactcacaccggggagaagccctacaagtgcagcgagtgtgggaaggccttcagttactgcgcagcgttcattcagcaccagaggattcacaccggggagaagccctacagatgtgccgcgtgtgggaaggccttcagccagagtgcaaaccatcagaggactcacactggggagaaaccctacaagtgcagcgagtgtgggaaggccttcagccagagtaccaatctcataatccaccaaaagacccacaccggggagaagccatataaatgtaatgaatgtgggaaattcttcagtgagagctcagccctcattcggcatcatataatccacaccggagatagtcagcatcagagaatccacacaggcgtgaaaccctacgaatgcagcgagtgtgggaaggccttccggtgcagctctgccttcgttagacatcagagactccacgccggagagtaactaggaacatggtagaagtggagagagtcccggacatgccgactcaggacaggtgggtgaggatctgagaaatgctaaaggcttgaaagcatctgaagacatctaacttagagtctgcagcccagagccacatgcaaaacaccttcaataaacagccactatttcacatgctgtaatgga

SEQ ID NO: 317679 - DNA, 795 bp, Homo sapiens
agcggaagtgggggaggaggaggaggagttggaaggggaggaggaagagggggagcaggaagaggggcagaaggaagaagaagagggggaggagaaagagatagaagaagagtcccacgaactggctgggtatacagaaatgtccagaggccggagagcgtttcagatcacatgtaccggatggcagttatggctatggtgatcaaagatgaccgtcttaacaaagaccggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacc

SEQ ID NO: 317680 - DNA, 1741 bp, Homo sapiens
  misc_feature (1673)..(1673): n is a, c, g, or t
  misc_feature (1741)..(1741): n is a, c, g, or t
agcggaagtgggggaggaggaggaggagttggaaggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaatattagaatatttattggagatttaaaatcatcttattctgacttaattaccgatatccccgaaggctaggttcattgaataatagaaaatttcattatgattgcttttaagaacagattcttcagctgatttagtgataagaatccagaaaagaaaatgtactagtgatgtattctctccccagatgaaattgctgccttattcagatttactctcttgagccagattttgaatttcactgcagactgcttcagacttctaatcataggcttgtaaacctactaataggctctgcccctcttcccaatactttttgtcatttagagatataaaccggggcatataaaaatgcaacttgtattcctttgtatatttttccctgtctgacttataaatcttgagacctttattgtaaaagcatttatcatcaggtgagaaatataaataggaactggggtcattgagcctcaggtagggaatatatcaacccgatttcttcctctcttttcccttttataggataaataatccaccctgtctgcctttacattgaatagtgcaaaaaagaatacgatttctgcaaantaaaattaaaaaaaaaaaatgcttttgcttgcggccgaatttcggcctacttggccattcgccttatn

SEQ ID NO: 317681 - DNA, 1551 bp, Homo sapiens
  misc_feature (1483)..(1483): n is a, c, g, or t
  misc_feature (1551)..(1551): n is a, c, g, or t
tgcggccgcgcgttgccgacggtggacggaggaagcagccggcgggacaggctggccagctggggcggcccggagtctgagcctagagcctggcgccgcgagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaatattagaatatttattggagatttaaaatcatcttattctgacttaattaccgatatccccgaaggctaggttcattgaataatagaaaatttcattatgattgcttttaagaacagattcttcagctgatttagtgataagaatccagaaaagaaaatgtactagtgatgtattctctccccagatgaaattgctgccttattcagatttactctcttgagccagattttgaatttcactgcagactgcttcagacttctaatcataggcttgtaaacctactaataggctctgcccctcttcccaatactttttgtcatttagagatataaaccggggcatataaaaatgcaacttgtattcctttgtatatttttccctgtctgacttataaatcttgagacctttattgtaaaagcatttatcatcaggtgagaaatataaataggaactggggtcattgagcctcaggtagggaatatatcaacccgatttcttcctctcttttcccttttataggataaataatccaccctgtctgcctttacattgaatagtgcaaaaaagaatacgatttctgcaaantaaaattaaaaaaaaaaaatgcttttgcttgcggccgaatttcggcctacttggccattcgccttatn

SEQ ID NO: 317682 - DNA, 1082 bp, Homo sapiens
agcggaagtgggggaggaggaggaggagttggaaggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacc

SEQ ID NO: 317683 - DNA, 1476 bp, Homo sapiens
  misc_feature (1408)..(1408): n is a, c, g, or t
  misc_feature (1476)..(1476): n is a, c, g, or t
ctcacaagaccctggcagaagcaggaagcggttgtgttgtgccaatggtggagaagaaaacttcggttcgctcccaggacccaggcagaagcaggacggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaatattagaatatttattggagatttaaaatcatcttattctgacttaattaccgatatccccgaaggctaggttcattgaataatagaaaatttcattatgattgcttttaagaacagattcttcagctgatttagtgataagaatccagaaaagaaaatgtactagtgatgtattctctccccagatgaaattgctgccttattcagatttactctcttgagccagattttgaatttcactgcagactgcttcagacttctaatcataggcttgtaaacctactaataggctctgcccctcttcccaatactttttgtcatttagagatataaaccggggcatataaaaatgcaacttgtattcctttgtatatttttccctgtctgacttataaatcttgagacctttattgtaaaagcatttatcatcaggtgagaaatataaataggaactggggtcattgagcctcaggtagggaatatatcaacccgatttcttcctctcttttcccttttataggataaataatccaccctgtctgcctttacattgaatagtgcaaaaaagaatacgatttctgcaaantaaaattaaaaaaaaaaaatgcttttgcttgcggccgaatttcggcctacttggccattcgccttatn

SEQ ID NO: 317684 - DNA, 1266 bp, Homo sapiens
agcggaagtgggggaggaggaggaggagttggaaggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacaccaaccaaaaaaaggggggggtaaaaggttcctcgaggggcgaggttagggtccgttttgtgagggcgataggggggtttatagagaggcgggggggtaaacagggggcgggacagtgggggattggagagccctctgggggataaggggacacagaggtaggggagaaaaaggttggggagttgg

SEQ ID NO: 317685 - DNA, 1206 bp, Homo sapiens
agcggaagtgggggaggaggaggaggagttggaaggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacaccttgaaaatagaatgtccttttttttggaggcgttaagaataaaagtcatatagccatattttgcccttttaggggtccgggaaatcacctatggtaggggttcctgggggggggggccgccccc

SEQ ID NO: 317686 - DNA, 1676 bp, Homo sapiens
  misc_feature (1608)..(1608): n is a, c, g, or t
  misc_feature (1676)..(1676): n is a, c, g, or t
gaacagtaagcaacaacagacacaggcaagaaaagacggtgagagaagagatgttgggttgaacagtcccccatgctagccgtcatggacatacaatagcttagagcttggttgctaccaaagcagaaatctggggaggtctgaggagcagggatgacagcacagatcagccaattgaagtgtagaggtgtttacaagagagacacctgcatccttgtttacatcatgagccagcctagcccctctgatcttcctccttgtcttttcatatataggtgcttcattctccttacttaattgcaggtttggaatgggcagagattgtcttcagctttctgggctctcacacctgagttttcccatagttcctggtagaggcactgaggagcctggtgaagtttcccctacctctgcctaattgatgattccttgcctgagtctcatccttattctcagttgcacctggggtgacagagcgtaaatgccaagtggtccccttcagccccttcccaggacctggaatctctttctgctttggaatgaagtgtgggtcagatcgtagactagagcccccagtgaaccctgggatcaagctggggaaatgaatatactctcttgtcaatatgggaatgtatttttccctgttcttttgctttgcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaatattagaatatttattggagatttaaaatcatcttattctgacttaattaccgatatccccgaaggctaggttcattgaataatagaaaatttcattatgattgcttttaagaacagattcttcagctgatttagtgataagaatccagaaaagaaaatgtactagtgatgtattctctccccagatgaaattgctgccttattcagatttactctcttgagccagattttgaatttcactgcagactgcttcagacttctaatcataggcttgtaaacctactaataggctctgcccctcttcccaatactttttgtcatttagagatataaaccggggcatataaaaatgcaacttgtattcctttgtatatttttccctgtctgacttataaatcttgagacctttattgtaaaagcatttatcatcaggtgagaaatataaataggaactggggtcattgagcctcaggtagggaatatatcaacccgatttcttcctctcttttcccttttataggataaataatccaccctgtctgcctttacattgaatagtgcaaaaaagaatacgatttctgcaaantaaaattaaaaaaaaaaaatgcttttgcttgcggccgaatttcggcctacttggccattcgccttatn

SEQ ID NO: 317687 - DNA, 890 bp, Homo sapiens
agcggaagtgggggaggaggaggaggagttggaaggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacc

SEQ ID NO: 317688 - DNA, 898 bp, Homo sapiens
agcggaagtgggggaggaggaggaggagttggaaggggaggaggaagagggggagcaggaagaggggcagaaggaagaagaagagggggaggagaaagagatagaagaagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacc

SEQ ID NO: 317689 - DNA, 1638 bp, Homo sapiens
  misc_feature (1570)..(1570): n is a, c, g, or t
  misc_feature (1638)..(1638): n is a, c, g, or t
agcggaagtgggggaggaggaggaggagttggaaggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaatattagaatatttattggagatttaaaatcatcttattctgacttaattaccgatatccccgaaggctaggttcattgaataatagaaaatttcattatgattgcttttaagaacagattcttcagctgatttagtgataagaatccagaaaagaaaatgtactagtgatgtattctctccccagatgaaattgctgccttattcagatttactctcttgagccagattttgaatttcactgcagactgcttcagacttctaatcataggcttgtaaacctactaataggctctgcccctcttcccaatactttttgtcatttagagatataaaccggggcatataaaaatgcaacttgtattcctttgtatatttttccctgtctgacttataaatcttgagacctttattgtaaaagcatttatcatcaggtgagaaatataaataggaactggggtcattgagcctcaggtagggaatatatcaacccgatttcttcctctcttttcccttttataggataaataatccaccctgtctgcctttacattgaatagtgcaaaaaagaatacgatttctgcaaantaaaattaaaaaaaaaaaatgcttttgcttgcggccgaatttcggcctacttggccattcgccttatn

SEQ ID NO: 317690 - DNA, 1454 bp, Homo sapiens
  misc_feature (1386)..(1386): n is a, c, g, or t
  misc_feature (1454)..(1454): n is a, c, g, or t
agcggaagtgggggaggaggaggaggagttggaaggggaggaggaagagggggagcaggaagaggggcagaaggaagaagaagagggggaggagaaagagatagaagaagagtcccacgaactggctgggtatacagaaatgtccagaggccggagagcgtttcagatcacatgtaccggatggcagttatggctatggtgatcaaagatgaccgtcttaacaaagaccggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaatattagaatatttattggagatttaaaatcatcttattctgacttaattaccgatatccccgaaggctaggttcattgaataatagaaaatttcattatgattgcttttaagaacagattcttcagctgatttagtgataagaatccagaaaagaaaatgtactagtgatgtattctctccccagatgaaattgctgccttattcagatttactctcttgagccagattttgaatttcactgcagactgcttcagacttctaatcataggcttgtaaacctactaataggctctgcccctcttcccaatactttttgtcatttagagatataaaccggggcatataaaaatgcaacttgtattcctttgtatatttttccctgtctgacttataaatcttgagacctttattgtaaaagcatttatcatcaggtgagaaatataaataggaactggggtcattgagcctcaggtagggaatatatcaacccgatttcttcctctcttttcccttttataggataaataatccaccctgtctgcctttacattgaatagtgcaaaaaagaatacgatttctgcaaantaaaattaaaaaaaaaaaatgcttttgcttgcggccgaatttcggcctacttggccattcgccttatn

SEQ ID NO: 317691 - DNA, 1557 bp, Homo sapiens
  misc_feature (1489)..(1489): n is a, c, g, or t
  misc_feature (1557)..(1557): n is a, c, g, or t
agcggaagtgggggaggaggaggaggagttggaaggggaggaggaagagggggagcaggaagaggggcagaaggaagaagaagagggggaggagaaagagatagaagaagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctaaaatattagaatatttattggagatttaaaatcatcttattctgacttaattaccgatatccccgaaggctaggttcattgaataatagaaaatttcattatgattgcttttaagaacagattcttcagctgatttagtgataagaatccagaaaagaaaatgtactagtgatgtattctctccccagatgaaattgctgccttattcagatttactctcttgagccagattttgaatttcactgcagactgcttcagacttctaatcataggcttgtaaacctactaataggctctgcccctcttcccaatactttttgtcatttagagatataaaccggggcatataaaaatgcaacttgtattcctttgtatatttttccctgtctgacttataaatcttgagacctttattgtaaaagcatttatcatcaggtgagaaatataaataggaactggggtcattgagcctcaggtagggaatatatcaacccgatttcttcctctcttttcccttttataggataaataatccaccctgtctgcctttacattgaatagtgcaaaaaagaatacgatttctgcaaantaaaattaaaaaaaaaaaatgcttttgcttgcggccgaatttcggcctacttggccattcgccttatn

SEQ ID NO: 317692 - DNA, 1294 bp, Homo sapiens
agcggaagtgggggaggaggaggaggagttggaaggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacctttaaccaaaaaaaaaaaaaaaaaaaaaaaaaaaaaacgcagagggcatcatattgccggggcgcggagaacaaagagggtgcaatcagaattgggccattgcgcaaacacgtggtcccctggccccagtctcttcgggcacacgggggaaaaccgcgcggggccccataaagaaagccggataaattccgagaaacccgtgtacctcgaag

SEQ ID NO: 317693 - DNA, 979 bp, Homo sapiens
agcggaagtgggggaggaggaggaggagttggaaggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcagaaagaagcactaacatagctgcagctgccagtgagccacactcctgagacactctctaaattgctgcactcctgtaacaaacattatttttccatttcattgtattgtgttttgccattgttggtctgttgatttccctagatgtgagtctgtttgttttcaattgtctgaacttcagcaagaaatgtgatacaacttgggcactaaaagaagccacagaacaggaagcggtcatgaaagtgccatggatgaacactggaggtggcagtgcctgtttatgaactaaataaataaatattaaacacc

SEQ ID NO: 317694 - DNA, 740 bp, Homo sapiens
agcggaagtgggggaggaggaggaggagttggaaggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggtactcaacaccattttcaacaagagtccattttagtttggcttactcagtgtagtgactaatgttaatattagggaaacccactgttggtaccttcatctgaccctttcatgtggag

SEQ ID NO: 317695 - DNA, 3520 bp, Homo sapiens
gcgcggcggccgccgaaggggcgggatccgaggcaagcgttggttctgtgcgcctcaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattcacttttatatgttttggaaagaaaattagtgaacttctctatgttaaaaatacgtactgcttgagtatcccctgtctgaaatgcttgggaccagaagtgtttcagcttttggatttttttgaattttggaatatttgcatagcataatgagatatcttgggaatgggacccaaatctaaacacaaaattcatttatgtttcatatacaccttatatacaataacctaaaggtgattttatatgatattttgagtaattttatgcatgaaacaaagttttgacaggcttttgaccgtgattcatcacatgagttcaggcatggaaattttcatttggagcatcatgtcagcactcaaaaagttctggatcttggagcagttcagattttcagattagggatgctcaaatctatatagatataaaattatcctcacagtaacatagaatctcttggtgctgtcagctgttgggaattgaagattgactttgtgcttccaccctccatccagaaaggcacccttcattccaccagaactttacccaggaagaacacgatcatttcctttttcaccgatgccctctctcagctttctgagtacgtctcttggggtcgctggaggtgatcctaggatctgtctctgagaccaatgtgctgtttcagccccctgcagctaagaattgtattgactgtcctcacagcggcttttcatagctttcagcttcagcttttacgaggcttctcctctctccctggcaccctgctggctgcctcactgcttacagacaggtcccaccaaacccaaacacctgcctagggtaaatgggtctctcttctatccccagaaactttcagaggaagcagctcatagaaacatacaaaagcacacaagtattttgggaaaaaatcctaaaaggtgacttaatttgatgccttaaattcacaagtgaggaagctaaggcctagaaggttaaggatgtccccagggtcacacagtgagcggggctcagagcttgagtgtctttgtgctttgtgtacattgtgttctccctagggtgctttagaccctgtttgttttcttctgcatgaggctgatttccagtttgtcatcaacctctttatcttataatttaggatagagttgaacgttagtcttgaaagattttctaaagtagtctttcaaactgttcctcagaggcctaggattttccaaaagtaccttaggaaccttgtaggctgcagtgggggtgtggcgatagagcaggaggcagggagacagggctgcagggcctcccaccttccaacagacaggctctgctgtatctgttgtacatactgggattctgtaaaggacattatctggggtgttgtatgtatttttgtgtgttctgctttttttaaataaacttgaaaagctactgaactaatt

SEQ ID NO: 317696 - DNA, 2530 bp, Homo sapiens
aacgccttcagcaagagccctctcacttcctttgtcttcaacccattctccgcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaactcacctgtgagtgaatctctgatccaggaggagcctcactcagcctgggaactttgaggtgctattgcaaggggaggtcctccacgtctgtccagcccaacctggtcattttacacacggaggcaaaggcccagagagatcacagagcttacccaaaatgaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagctttgcataattatcaaagcaggaaatgcagatcagtcttctgcagtgttttagctgcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaa

SEQ ID NO: 317697 - DNA, 3740 bp, Homo sapiens
aacgccttcagcaagagccctctcacttcctttgtcttcaacccattctccgcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattcacttttatatgttttggaaagaaaattagtgaacttctctatgttaaaaatacgtactgcttgagtatcccctgtctgaaatgcttgggaccagaagtgtttcagcttttggatttttttgaattttggaatatttgcatagcataatgagatatcttgggaatgggacccaaatctaaacacaaaattcatttatgtttcatatacaccttatatacaataacctaaaggtgattttatatgatattttgagtaattttatgcatgaaacaaagttttgacaggcttttgaccgtgattcatcacatgagttcaggcatggaaattttcatttggagcatcatgtcagcactcaaaaagttctggatcttggagcagttcagattttcagattagggatgctcaaatctatatagatataaaattatcctcacagtaacatagaatctcttggtgctgtcagctgttgggaattgaagattgactttgtgcttccaccctccatccagaaaggcacccttcattccaccagaactttacccaggaagaacacgatcatttcctttttcaccgatgccctctctcagctttctgagtacgtctcttggggtcgctggaggtgatcctaggatctgtctctgagaccaatgtgctgtttcagccccctgcagctaagaattgtattgactgtcctcacagcggcttttcatagctttcagcttcagcttttacgaggcttctcctctctccctggcaccctgctggctgcctcactgcttacagacaggtcccaccaaacccaaacacctgcctagggtaaatgggtctctcttctatccccagaaactttcagaggaagcagctcatagaaacatacaaaagcacacaagtattttgggaaaaaatcctaaaaggtgacttaatttgatgccttaaattcacaagtgaggaagctaaggcctagaaggttaaggatgtccccagggtcacacagtgagcggggctcagagcttgagtgtctttgtgctttgtgtacattgtgttctccctagggtgctttagaccctgtttgttttcttctgcatgaggctgatttccagtttgtcatcaacctctttatcttataatttaggatagagttgaacgttagtcttgaaagattttctaaagtagtctttcaaactgttcctcagaggcctaggattttccaaaagtaccttaggaaccttgtaggctgcagtgggggtgtggcgatagagcaggaggcagggagacagggctgcagggcctcccaccttccaacagacaggctctgctgtatctgttgtacatactgggattctgtaaaggacattatctggggtgttgtatgtatttttgtgtgttctgctttttttaaataaacttgaaaagctactgaactaatt

SEQ ID NO: 317698 - DNA, 3781 bp, Homo sapiens
gcgcggcggccgccgaaggggcgggatccgaggcaagcgttggttctgtgcgcctcaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggccattttgtacatctctgcctgtgctagagaagagctggttaacaaacagccttctgtgttgggagaaactcggacgtttgtctagcaccatttccagaactcacctgtgagtgaatctctgatccaggaggagcctcactcagcctgggaactttgaggtgctattgcaaggggaggtcctccacgtctgtccagcccaacctggtcattttacacacggaggcaaaggcccagagagatcacagagcttacccaaaatgaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattcacttttatatgttttggaaagaaaattagtgaacttctctatgttaaaaatacgtactgcttgagtatcccctgtctgaaatgcttgggaccagaagtgtttcagcttttggatttttttgaattttggaatatttgcatagcataatgagatatcttgggaatgggacccaaatctaaacacaaaattcatttatgtttcatatacaccttatatacaataacctaaaggtgattttatatgatattttgagtaattttatgcatgaaacaaagttttgacaggcttttgaccgtgattcatcacatgagttcaggcatggaaattttcatttggagcatcatgtcagcactcaaaaagttctggatcttggagcagttcagattttcagattagggatgctcaaatctatatagatataaaattatcctcacagtaacatagaatctcttggtgctgtcagctgttgggaattgaagattgactttgtgcttccaccctccatccagaaaggcacccttcattccaccagaactttacccaggaagaacacgatcatttcctttttcaccgatgccctctctcagctttctgagtacgtctcttggggtcgctggaggtgatcctaggatctgtctctgagaccaatgtgctgtttcagccccctgcagctaagaattgtattgactgtcctcacagcggcttttcatagctttcagcttcagcttttacgaggcttctcctctctccctggcaccctgctggctgcctcactgcttacagacaggtcccaccaaacccaaacacctgcctagggtaaatgggtctctcttctatccccagaaactttcagaggaagcagctcatagaaacatacaaaagcacacaagtattttgggaaaaaatcctaaaaggtgacttaatttgatgccttaaattcacaagtgaggaagctaaggcctagaaggttaaggatgtccccagggtcacacagtgagcggggctcagagcttgagtgtctttgtgctttgtgtacattgtgttctccctagggtgctttagaccctgtttgttttcttctgcatgaggctgatttccagtttgtcatcaacctctttatcttataatttaggatagagttgaacgttagtcttgaaagattttctaaagtagtctttcaaactgttcctcagaggcctaggattttccaaaagtaccttaggaaccttgtaggctgcagtgggggtgtggcgatagagcaggaggcagggagacagggctgcagggcctcccaccttccaacagacaggctctgctgtatctgttgtacatactgggattctgtaaaggacattatctggggtgttgtatgtatttttgtgtgttctgctttttttaaataaacttgaaaagctactgaactaatt

SEQ ID NO: 317699 - DNA, 3938 bp, Homo sapiens
gcgcggcggccgccgaaggggcgggatccgaggcaagcgttggttctgtgcgcctcaggtacgtgttgggcggcagtgggcgcggactcggtgcggtctctcgcgggctgcggtcgggcccgggatcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacaggcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattcacttttatatgttttggaaagaaaattagtgaacttctctatgttaaaaatacgtactgcttgagtatcccctgtctgaaatgcttgggaccagaagtgtttcagcttttggatttttttgaattttggaatatttgcatagcataatgagatatcttgggaatgggacccaaatctaaacacaaaattcatttatgtttcatatacaccttatatacaataacctaaaggtgattttatatgatattttgagtaattttatgcatgaaacaaagttttgacaggcttttgaccgtgattcatcacatgagttcaggcatggaaattttcatttggagcatcatgtcagcactcaaaaagttctggatcttggagcagttcagattttcagattagggatgctcaaatctatatagatataaaattatcctcacagtaacatagaatctcttggtgctgtcagctgttgggaattgaagattgactttgtgcttccaccctccatccagaaaggcacccttcattccaccagaactttacccaggaagaacacgatcatttcctttttcaccgatgccctctctcagctttctgagtacgtctcttggggtcgctggaggtgatcctaggatctgtctctgagaccaatgtgctgtttcagccccctgcagctaagaattgtattgactgtcctcacagcggcttttcatagctttcagcttcagcttttacgaggcttctcctctctccctggcaccctgctggctgcctcactgcttacagacaggtcccaccaaacccaaacacctgcctagggtaaatgggtctctcttctatccccagaaactttcagaggaagcagctcatagaaacatacaaaagcacacaagtattttgggaaaaaatcctaaaaggtgacttaatttgatgccttaaattcacaagtgaggaagctaaggcctagaaggttaaggatgtccccagggtcacacagtgagcggggctcagagcttgagtgtctttgtgctttgtgtacattgtgttctccctagggtgctttagaccctgtttgttttcttctgcatgaggctgatttccagtttgtcatcaacctctttatcttataatttaggatagagttgaacgttagtcttgaaagattttctaaagtagtctttcaaactgttcctcagaggcctaggattttccaaaagtaccttaggaaccttgtaggctgcagtgggggtgtggcgatagagcaggaggcagggagacagggctgcagggcctcccaccttccaacagacaggctctgctgtatctgttgtacatactgggattctgtaaaggacattatctggggtgttgtatgtatttttgtgtgttctgctttttttaaataaacttgaaaagctactgaactaatt

SEQ ID NO: 317700 - DNA, 2688 bp, Homo sapiens
gcgcggcggccgccgaaggggcgggatccgaggcaagcgttggttctgtgcgcctcaggtacgtgttgggcggcagtgggcgcggactcggtgcggtctctcgcgggctgcggtcgggcccgggatcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacaggcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaagggtaagaggatgctgggtgtcaaggagctgttgaattgcccttgagagtctctcctccgtgaaacaaggagggcagcctagaatagtttctgagaactcttctttgtgttcttaactactttcaggaaaaaaattcttgacaggcaagtgcattagtataacagcagactgtttacttaactcaggcagagcgtgtgttctcaaaaccctgtagctcaaccccttatatcacttagcacgatgtttagcattatttaactttttaagatgaagcttgatgagtaacagtttatcaacaaggtagcaaatacttgacaacagtagtagttctccatgggccctggaccagcagcctcagcatcacctgcaacttgttaaaatgcaaattctcgggccccattcccgattcattaaattggactctgagggtgagatcctgcagtctgtgttttcacgagcccttgaggggattctactgcccagtcaagtttgagaaccactgcttaaaagcctggttttagttcctggtgaagaagaagaagaaaaaacaaaatagtgcctgagtgcaaatagatgtttcagttatggatcaaaagatggccttagtttgctctccttattcctcagggagcacctgcaggaggaagagcaggagctctagaatctgctttctggcctcaccactcatttgctgtatggattgttaacacaggacctaacattctctgaattttagtttgctcatctttaaactggaaatgcagaaaaatgggagcaaatatatgaagtaaccagtgtaatatattcacatggcagatacaataaacattattacccttatttcagatttttttcctgtcccatatttaagaatagtaatgttcactgtcagcagtgttgttctttttttatatatccagtatataattgtatattgtgtgtgatgtatacatgttggagtatttcatactgtagagtgttctacaggttgttttctttttgagaatctcttatcttggtactttgtcaagttttttgtttgtttgagacagactgacaaatatttagagaattttgccaagttttgctctatataataaaataaccggcaattagcaccaaggtattgtggtaacatgataggagctcttacatatattttctcctttaatcctcaggacagtcttatgagtagatgttacaatcgtattccttggataaatgatgcatctgcactttagaaaagtgcccaaggtcgtagagctggtaatgacattctggcatcagaatccatgctgtttgctatagcactctaccatgtgccataattgtagatggcttagaagatctcatggaggaagggggacttcaaaaggcctttgaaagatgggtaaaatttagaagggaagaaatacatgctggtgggggcaaatggaagaatatttgcagtttatctctgcaactctcccaataaggtagaaccttccttaacaatttttttgttgttgttctctgaaaatcgttctaccc

SEQ ID NO: 317701 - DNA, 498 bp, Homo sapiens
gcgcggcggccgccgaaggggcgggatccgaggcaagcgttggttctgtgcgcctcaggtacgtgttgggcggcagtgggcgcggactcggtgcggtctctcgcgggctgcggtcgggcccgggatcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacaggtgcgtggtcccagaaagtgagtaggaaagcgcccaccacgtgccaggcgcttaagctttctgtgctcggtttcccagtataggaggacggtcacggtacgtagtatagagttgtcctgagggtgaagcgag

SEQ ID NO: 317702 - DNA, 454 bp, Homo sapiens
  misc_feature (449)..(449): n is a, c, g, or t
gcgcggcggccgccgaaggggcgggatccgaggcaagcgttggttctgtgcgcctcaggtacgtgttgggcggcagtgggcgcggactcggtgcggtctctcgcgggctgcggtcgggcccgggatcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttatttcccccccccaaaggggaaaaccccctaaaaagccttttaaaccaagggggggttgggggcccggggttggcccagaaagtgagtggaaagcgcccaccacntgcca

SEQ ID NO: 317703 - DNA, 459 bp, Homo sapiens
ggcctggtcatgttaatagtgtgctaaatatttccccactcccccagttggtgtattttctttgaaacaaatttaagctggtgtctttttagagcctttagtgtgttaataaagttgtgaatctccaagagaagaactgaatacgaaagcttttatgaactttttaaactactaaccctctgtacttggtgcacatatgctagatccaggttttgatccccttttcaagaggggtttgctttttaaaagggagctttagggatttgctcaacaagttcagctattgttcttgattatgactaactttaattttcttttgtttaagccattttgtacatctctgcctgtgctagagaagagctggttaacaaacagccttctgtgttgggagaaactcggacgtttgtctagcaccatttccaggttcacgttttctctgtcatcctcctctgcctcacc

SEQ ID NO: 317704 - DNA, 533 bp, Homo sapiens
gtattttgccttttttgtattttgtttcattcaacaagcttttgctgagcctctactcataacacaccgtggaagcatgattcttccctttaaggagctcacagttcaggcaggagacatatacacacatgctgttaaaagcacaacagaaataatatgtatgcatgtatgtatgttcatggcaaaaatggaaaggctatatgctgaaaggttgcagtgcttcttgtgaaaagtgggaagtttataattctaaaatgggcatgcgttacttgaatggagtttcataaaatctcacaggtcacagagtcgtgtagccactgttgatttttagataataggctctttgttttcatgcagtttcctaatattaggattatgatcaattttatttcataattagtaacttttgtcttttctgtcactagcaaatggtcagctgagacttctggccgcagcaatgccatgccacatattaagacatatatgaggccttctccagacttcagtaaaattgcttggttccttgtcacaag

SEQ ID NO: 317705 - DNA, 2317 bp, Homo sapiens
gcgcggcggccgccgaaggggcgggatccgaggcaagcgttggttctgtgcgcctcaggcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaa

SEQ ID NO: 317706 - DNA, 4055 bp, Homo sapiens
gcgcggcggccgccgaaggggcgggatccgaggcaagcgttggttctgtgcgcctcaggtacgtgttgggcggcagtgggcgcggactcggtgcggtctctcgcgggctgcggtcgggcccgggatcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacaggcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattcacttttatatgttttggaaagaaaattagtgaacttctctatgttaaaaatacgtactgcttgagtatcccctgtctgaaatgcttgggaccagaagtgtttcagcttttggatttttttgaattttggaatatttgcatagcataatgagatatcttgggaatgggacccaaatctaaacacaaaattcatttatgtttcatatacaccttatatacaataacctaaaggtgattttatatgatattttgagtaattttatgcatgaaacaaagttttgacaggcttttgaccgtgattcatcacatgagttcaggcatggaaattttcatttggagcatcatgtcagcactcaaaaagttctggatcttggagcagttcagattttcagattagggatgctcaaatctatatagatataaaattatcctcacagtaacatagaatctcttggtgctgtcagctgttgggaattgaagattgactttgtgcttccaccctccatccagaaaggcacccttcattccaccagaactttacccaggaagaacacgatcatttcctttttcaccgatgccctctctcagctttctgagtacgtctcttggggtcgctggaggtgatcctaggatctgtctctgagaccaatgtgctgtttcagccccctgcagctaagaattgtattgactgtcctcacagcggcttttcatagctttcagcttcagcttttacgaggcttctcctctctccctggcaccctgctggctgcctcactgcttacagacaggtcccaccaaacccaaacacctgcctagggtaaatgggtctctcttctatccccagaaactttcagaggaagcagctcatagaaacatacaaaagcacacaagtattttgggaaaaaatcctaaaaggtgacttaatttgatgccttaaattcacaagtgaggaagctaaggcctagaaggttaaggatgtccccagggtcacacagtgagcggggctcagagcttgagtgtctttgtgctttgtgtacattgtgttctccctagggtgctttagaccctgtttgttttcttctgcatgaggctgatttccagtttgtcatcaacctctttatcttataatttaggatagagttgaacgttagtcttgaaagattttctaaagtagtctttcaaactgttcctcagaggcctaggattttccaaaagtaccttaggaaccttgtaggctgcagtgggggtgtggcgatagagcaggaggcagggagacagggctgcagggcctcccaccttccaacagacaggctctgctgtatctgttgtacatactgggattctgtaaaggacattatctggggtgttgtatgtatttttgtgtgttctgctttttttaaataaacttgaaaagctactgaactaatt

SEQ ID NO: 317707 - DNA, 3574 bp, Homo sapiens
tgctacagggttatagctctatttgcactcgctgtttagctggtccgaatttcttgtcctgcgtccaagaataatgaggttaggctgacaaccgaaggggaaaagggcggaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattcacttttatatgttttggaaagaaaattagtgaacttctctatgttaaaaatacgtactgcttgagtatcccctgtctgaaatgcttgggaccagaagtgtttcagcttttggatttttttgaattttggaatatttgcatagcataatgagatatcttgggaatgggacccaaatctaaacacaaaattcatttatgtttcatatacaccttatatacaataacctaaaggtgattttatatgatattttgagtaattttatgcatgaaacaaagttttgacaggcttttgaccgtgattcatcacatgagttcaggcatggaaattttcatttggagcatcatgtcagcactcaaaaagttctggatcttggagcagttcagattttcagattagggatgctcaaatctatatagatataaaattatcctcacagtaacatagaatctcttggtgctgtcagctgttgggaattgaagattgactttgtgcttccaccctccatccagaaaggcacccttcattccaccagaactttacccaggaagaacacgatcatttcctttttcaccgatgccctctctcagctttctgagtacgtctcttggggtcgctggaggtgatcctaggatctgtctctgagaccaatgtgctgtttcagccccctgcagctaagaattgtattgactgtcctcacagcggcttttcatagctttcagcttcagcttttacgaggcttctcctctctccctggcaccctgctggctgcctcactgcttacagacaggtcccaccaaacccaaacacctgcctagggtaaatgggtctctcttctatccccagaaactttcagaggaagcagctcatagaaacatacaaaagcacacaagtattttgggaaaaaatcctaaaaggtgacttaatttgatgccttaaattcacaagtgaggaagctaaggcctagaaggttaaggatgtccccagggtcacacagtgagcggggctcagagcttgagtgtctttgtgctttgtgtacattgtgttctccctagggtgctttagaccctgtttgttttcttctgcatgaggctgatttccagtttgtcatcaacctctttatcttataatttaggatagagttgaacgttagtcttgaaagattttctaaagtagtctttcaaactgttcctcagaggcctaggattttccaaaagtaccttaggaaccttgtaggctgcagtgggggtgtggcgatagagcaggaggcagggagacagggctgcagggcctcccaccttccaacagacaggctctgctgtatctgttgtacatactgggattctgtaaaggacattatctggggtgttgtatgtatttttgtgtgttctgctttttttaaataaacttgaaaagctactgaactaatt

SEQ ID NO: 317708 - DNA, 2170 bp, Homo sapiens
gcgcggcggccgccgaaggggcgggatccgaggcaagcgttggttctgtgcgcctcaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttgcccctgcgaagagaataaaggatgaagtggaggcttcgttctctggtaacgcatggataagctgaggaaacagacactgggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaa

SEQ ID NO: 317709 - DNA, 2461 bp, Homo sapiens
gcgcggcggccgccgaaggggcgggatccgaggcaagcgttggttctgtgcgcctcaggtacgtgttgggcggcagtgggcgcggactcggtgcggtctctcgcgggctgcggtcgggcccgggatcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaagggtaagaggatgctgggtgtcaaggagctgttgaattgcccttgagagtctctcctccgtgaaacaaggagggcagcctagaatagtttctgagaactcttctttgtgttcttaactactttcaggaaaaaaattcttgacaggcaagtgcattagtataacagcagactgtttacttaactcaggcagagcgtgtgttctcaaaaccctgtagctcaaccccttatatcacttagcacgatgtttagcattatttaactttttaagatgaagcttgatgagtaacagtttatcaacaaggtagcaaatacttgacaacagtagtagttctccatgggccctggaccagcagcctcagcatcacctgcaacttgttaaaatgcaaattctcgggccccattcccgattcattaaattggactctgagggtgagatcctgcagtctgtgttttcacgagcccttgaggggattctactgcccagtcaagtttgagaaccactgcttaaaagcctggttttagttcctggtgaagaagaagaagaaaaaacaaaatagtgcctgagtgcaaatagatgtttcagttatggatcaaaagatggccttagtttgctctccttattcctcagggagcacctgcaggaggaagagcaggagctctagaatctgctttctggcctcaccactcatttgctgtatggattgttaacacaggacctaacattctctgaattttagtttgctcatctttaaactggaaatgcagaaaaatgggagcaaatatatgaagtaaccagtgtaatatattcacatggcagatacaataaacattattacccttatttcagatttttttcctgtcccatatttaagaatagtaatgttcactgtcagcagtgttgttctttttttatatatccagtatataattgtatattgtgtgtgatgtatacatgttggagtatttcatactgtagagtgttctacaggttgttttctttttgagaatctcttatcttggtactttgtcaagttttttgtttgtttgagacagactgacaaatatttagagaattttgccaagttttgctctatataataaaataaccggcaattagcaccaaggtattgtggtaacatgataggagctcttacatatattttctcctttaatcctcaggacagtcttatgagtagatgttacaatcgtattccttggataaatgatgcatctgcactttagaaaagtgcccaaggtcgtagagctggtaatgacattctggcatcagaatccatgctgtttgctatagcactctaccatgtgccataattgtagatggcttagaagatctcatggaggaagggggacttcaaaaggcctttgaaagatgggtaaaatttagaagggaagaaatacatgctggtgggggcaaatggaagaatatttgcagtttatctctgcaactctcccaataaggtagaaccttccttaacaatttttttgttgttgttctctgaaaatcgttctaccc

SEQ ID NO: 317710 - DNA, 982 bp, Homo sapiens
gcgcggcggccgccgaaggggcgggatccgaggcaagcgttggttctgtgcgcctcaggtacgtgttgggcggcagtgggcgcggactcggtgcggtctctcgcgggctgcggtcgggcccgggatcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacaggcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggtaggagaattgcttgaacctgggaggcagagaggttggagtgagccgagattgcgccattgcgctccagcctgagcggcagagcgagactctgtctcaaaaaaataaatgtaaatcggactccccttcttaaagccctcagtggggtcccattgatcattgcataaaatccaatttctttaacaagtcttctcccctcacccgcttcggaccactgcctgccttgcctaagtcctttcttatgacctctttcccacctctgccggctgggttccctctacttgggaatgctcttcaccccatcatttagacagcaggttccttttggccctctgggtctcatttatatgttactttttaagtatattccaaaggtcacccctattttt

SEQ ID NO: 317711 - DNA, 1166 bp, Homo sapiens
cttttctgcgggtcttggcacctttcttggccacagatttctgggttacagagcatgtgtgtctgaggcattgcaggcagaaaagggtggccgacgtgacctctagctggactgctgggcaggggagctgtcctagataaaattggaaagcaccttgtccaatgggaggacctaagtgggagagtgagagtcctgctttgagaagctaagatggtggatggtgcagaaacagtgacccagagacaggtggacaaagaattcggggactgatgggaactgagcttgggatccagactgaaactgattccagactgacctctagcacccaggacccagacacagggccatgggaccccagcatttgagacttgtgcagctgttctgccttctaggggccatctccactctgcctcgggctggagctcttttgtgctatgaagcaacagcctcaagattcagagctgttgctttccataactggaagtggcttctgatgaggaacatggtgtgtaagctgcaagagggctgcgaggagacgctagtgttcattgagacagggactgcaaggggagttgtgggctttaaaggctgcagctcgtcttcgtcttaccctgcgcaaatctcctaccttgtttccccacccggagtgtccattgcctcctacagtcgcgtctgccggtcttatctctgcaacaacctcaccaatttggagccttttgtgaaactcaaggccagcactcctaagtctatcacatctgcgtcctgtagctgcccgacctgtgtgggcgagcacatgaaggattgcctcccaaattttgtcaccactaattcttgccccttggctgcttctacgtgttacagttccaccttaaaatttcaggcagggtttctcaataccaccttcctcctcatggggtgtgctcgtgaacataaccagcttttagcagattttcatcatattgggagcatcaaagtgactgaggtcctcaacatcttagagaagtctcagattgttggtgcagcatcctccaggcaagatcctgcttggggtgtcgtcttaggcctcctgtttgccttcagggactgaccatctagctgcacccgacaagcacccagactctttcacataacaaataaaatagcagagttccctttaaaaaatgtcc

SEQ ID NO: 317712 - DNA, 457 bp, Homo sapiens
ttttttttttgcttgaggatttcacttcaatcttttctggttgcgtctccacttgtactcagcttgttaggtccaggtccagttgttctgcatctgaggctggcgtgtgctgtcttctctgattggcctaatctccctcacccccgtgagatctgttgtcagccttcgtttctctttcctgtgtcccagcttttctgcgggtcttggcacctttcttggccacagatttctgggttacagagcatgtgtgtctgaggcattgcaggcagaaaagggtggccgacgtgacctctagctggactgctgggcaggggagctgtcctagataaaattggaaaggttgggtggcgcttatctggggtggggtggggtgtggtcgggggaggcttaaaggccagctaaagaggttgaacttgatcctttaggtagtggagagagagtgagaggaagtgtgtgt

SEQ ID NO: 317713 - DNA, 1061 bp, Homo sapiens
cttttctgcgggtcttggcacctttcttggccacagatttctgggttacagagcatgtgtgtctgaggcattgcaggcagaaaagggtggccgacgtgacctctagctggactgctgggcaggggagctgtcctagataaaattggaaagcaccttgtccaatgggaggacctaagtgggagagtgagagtcctgctttgagaagctaagatggtggatggtgcagaaacagtgacccagagacaggtggacaaagaattcggggactgatgggaactgagcttgggatccagactgaaactgattccagactgacctctagcacccaggacccagacacagggccatgggaccccagcatttgagacttgtgcagctgttctgccttctaggggccatctccactctgcctcgtatgtcctgtggggctggatgctataagacccagaaagggactgcaaggggagttgtgggctttaaaggctgcagctcgtcttcgtcttaccctgcgcaaatctcctaccttgtttccccacccggagtgtccattgcctcctacagtcgcgtctgccggtcttatctctgcaacaacctcaccaatttggagccttttgtgaaactcaaggccagcactcctaagtctatcacatctgcgtcctgtagctgcccgacctgtgtgggcgagcacatgaaggattgcctcccaaattttgtcaccactaattcttgccccttggctgcttctacgtgttacagttccaccttaaaatttcaggcagggtttctcaataccaccttcctcctcatggggtgtgctcgtgaacataaccagcttttagcagattttcatcatattgggagcatcaaagtgactgaggtcctcaacatcttagagaagtctcagattgttggtgcagcatcctccaggcaagatcctgcttggggtgtcgtcttaggcctcctgtttgccttcagggactgaccatctagctgcacccgacaagcacccagactctttcacataacaaataaaatagcagagttccctttaaaaaatgtcc

SEQ ID NO: 317714 - DNA, 712 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317715 - DNA, 668 bp, Homo sapiens
tatacggcaggtagcgaggctgggtggcgggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317716 - DNA, 811 bp, Homo sapiens
tatacggcaggtagcgaggctgggtggcgggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaacaaaacacaaaaaaaaaaaaaaaacttgcgggggccttattttcggggggggggaaaaagggtttgaaaaggggctggggccaatggtggttctccggacccacttttttggtacaagggggaaaattgccgggccccaaagggg

SEQ ID NO: 317717 - DNA, 662 bp, Homo sapiens
tatacggcaggtagcgaggctgggtggcgggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317718 - DNA, 816 bp, Homo sapiens
  misc_feature (37)..(37): n is a, c, g, or t
  misc_feature (719)..(719): n is a, c, g, or t
  misc_feature (721)..(721): n is a, c, g, or t
gaccacgcgtcgcggacgcgtgggtcgaccacgcgtncggacccacgcgtccgggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaacaaaacacaaaaaaaaaaaaaaaaccaananaaaatatttgcgggcgcacaaaaaggtagaaagacagcaaaagacaaaaggataagacacatattacaaagaggaaaatgcaagcacaaaaaaca

SEQ ID NO: 317719 - DNA, 756 bp, Homo sapiens
ccgatgccatccgcgacttacgggtggcggcggggcgcgggctgcggagaggactggtggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaatcataatacaaaacctaacttccaaccaaccctccaacccaaaccacacaacaacacaaaccatcaccccaaccacaaca

SEQ ID NO: 317720 - DNA, 133 bp, Homo sapiens
tcaagcttctaacgatgtacggggacatgaggacagaaggactggtgcgaccccccacccccgcccctgggctaccatctgcatggggctggggtcctcctgtgctatttgtacaaataaacctgaggcagga

SEQ ID NO: 317721 - DNA, 385 bp, Homo sapiens
ggagacaggaatgcttttccacagtgttatactaatttatactaccaccagttgtgtcaaagtgttccttttccaccacatccatgcagatatctatttgtttttttttttactttttaatagtagctattttttcaggagtaaagtggtatctcattgtggttttaatttgcatttccctgatgattagtgatgttgagcaatttctcatatgtttgttggctgtttgtatgacttcttttgcaaattgtccattcatgtcctttgcccaatttttgatgaggacagaaggactggtgcgaccccccacccccgcccctgggctaccatctgcatggggctggggtcctcctgtgctatttgtacaaataaacctgaggcagga

SEQ ID NO: 317722 - DNA, 400 bp, Homo sapiens
  misc_feature (35)..(36): n is a, c, g, or t
gcggcgcctactactactactaaattcgcggccgnncgacgcccgtcgacgatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317723 - DNA, 303 bp, Homo sapiens
gggggtgtagctcagtggagagcatttgactggaactgaagctggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317724 - DNA, 649 bp, Homo sapiens
gaattcggcacgcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317725 - DNA, 747 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggagcaggatttgttagcctctgtctatgatcctgggg

SEQ ID NO: 317726 - DNA, 1574 bp, Homo sapiens
gcttttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtgagtgcactgaatcacatggaagtgtcttttcttggttccaggtgcacagtcaaggcctctcatgtagtttttctctagctttggcttctgcctgagcacagcctaactggcccacccaaagcctgcaattcctttttctaccctaccagacccataataaagctttccttggtctccacagcctgaagtgtaaccctctggtcagggtgtaacctgcctcctgagggcagtttggctatctcccttgcttggcagtggcacttagggtaaggagtggccttgtctgagtgcgtgcagggcacattcccacactgaccagccttatgacctccatctgacccagtgctggagttggggtcagcttctcttcctgtgtcagggggttctaaggattagctgagaaggctggagggtctaggggagagctgagcatgtccccagtctgttccttccctttacttttgctctctgttccgtggagtgaatcacaaactctgagcctcagtttccccatatcccaccttggctataagtcttttggaccagacttggtatttaattgacaccttcttctaaagaggggagggggtgtccctgaggggatgtcaggaaaaaacttggtcgaacccctgctgtaggaagttgaagccccacaaccttggcagacagggcagcaaagcagcttgtaattttgttcttgaaggaggtctgcacagcattacccaggtggcgtattggctccctggggtggtggtacactttctctggaaatagtttcaagaggttgggtatttccacatttgaggttgacttgatgctgtctttagaatgctgggtacccctatggagaggggcagcagggagagacttggggacccacatgctgccacctgtacctttcctgcttttcaggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317727 - DNA, 1882 bp, Homo sapiens
gaattcggcacgcgcttcgggagccgcggcttatggtgcagacatggccaagtccaagaaccacaccacacacaaccagtgtaagttttttgggccctgcctacatcccagaccctggcaaggactggttcaggcaaactgggacagagatgaaggggcacgtttccattgtgggcctgaggctgattgatttcacccagtaataactttagggtttataggtttagagatctacttgagatacagagtgttttgcatttagtagtaagggtttcccatatctcaagtgtagctgctgtaggaagtgttggttctcccagacttgccagctgtgatgttgggtggtcttattagaggaaagttctttgttggcttaattccctttttttctcccacagcccgaaaatggcacagaaatggtatcaagaaaccccgatcacaaagatacgaatctcttaagggggtgagtgcactgaatcacatggaagtgtcttttcttggttccaggtgcacagtcaaggcctctcatgtagtttttctctagctttggcttctgcctgagcacagcctaactggcccacccaaagcctgcaattcctttttctaccctaccagacccataataaagctttccttggtctccacagcctgaagtgtaaccctctggtcagggtgtaacctgcctcctgagggcagtttggctatctcccttgcttggcagtggcacttagggtaaggagtggccttgtctgagtgcgtgcagggcacattcccacactgaccagccttatgacctccatctgacccagtgctggagttggggtcagcttctcttcctgtgtcagggggttctaaggattagctgagaaggctggagggtctaggggagagctgagcatgtccccagtctgttccttccctttacttttgctctctgttccgtggagtgaatcacaaactctgagcctcagtttccccatatcccaccttggctataagtcttttggaccagacttggtatttaattgacaccttcttctaaagaggggagggggtgtccctgaggggatgtcaggaaaaaacttggtcgaacccctgctgtaggaagttgaagccccacaaccttggcagacagggcagcaaagcagcttgtaattttgttcttgaaggaggtctgcacagcattacccaggtggcgtattggctccctggggtggtggtacactttctctggaaatagtttcaagaggttgggtatttccacatttgaggttgacttgatgctgtctttagaatgctgggtacccctatggagaggggcagcagggagagacttggggacccacatgctgccacctgtacctttcctgcttttcaggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317728 - DNA, 820 bp, Homo sapiens
gcaaatggcaggacgaggctggtgtaaattcggacaggggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaacaaaacacaaaaaaaaaaaaaaaacttgcgggggccttattttcggggggggggaaaaagggtttgaaaaggggctggggccaatggtggttctccggacccacttttttggtacaagggggaaaattgccgggccccaaagggg

SEQ ID NO: 317729 - DNA, 818 bp, Homo sapiens
gtagcctgaacattcgtgtcctctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaacaaaacacaaaaaaaaaaaaaaaacttgcgggggccttattttcggggggggggaaaaagggtttgaaaaggggctggggccaatggtggttctccggacccacttttttggtacaagggggaaaattgccgggccccaaagggg

SEQ ID NO: 317730 - DNA, 934 bp, Homo sapiens
ggcctatgtcgcgggcctgtaccggggtcggctgttctccttgcgggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaacaaaaaacaaaacaaaaaaaaaaaaaaaaaaaaaggggggggcgcaaaaaaaatacaccaggggagcacaagacaaccggtaacccagaatccgtgatcaccagaggggcccccaaaaggaggctgcgcatatcacgacaccgccagcccgcgggttgcaaccgccgcggcccggggacaacgcgcacacccgggcacctgggcacaggcacccaaacacagggggggcgacacacgggcaaacgc

SEQ ID NO: 317731 - DNA, 816 bp, Homo sapiens
  misc_feature (780)..(780): n is a, c, g, or t
  misc_feature (790)..(790): n is a, c, g, or t
  misc_feature (792)..(793): n is a, c, g, or t
  misc_feature (798)..(798): n is a, c, g, or t
  misc_feature (805)..(805): n is a, c, g, or t
  misc_feature (812)..(812): n is a, c, g, or t
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaaaaaaaaaaaaaaaaaaaaaaaaaaaaaaaaaaaaaaaaaaaaaaaaaaagaaaaaaagaaagaanaagaacaaananngaagnaaaaganagaaaanaaga

SEQ ID NO: 317732 - DNA, 795 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaatcataatacaaaacctaacttccaaccaaccctccaacccaaaccacacaacaacacaaaccatcaccccaaccacaaca

SEQ ID NO: 317733 - DNA, 1603 bp, Homo sapiens
  misc_feature (1567)..(1567): n is a, c, g, or t
  misc_feature (1577)..(1577): n is a, c, g, or t
  misc_feature (1579)..(1580): n is a, c, g, or t
  misc_feature (1585)..(1585): n is a, c, g, or t
  misc_feature (1592)..(1592): n is a, c, g, or t
  misc_feature (1599)..(1599): n is a, c, g, or t
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaacaaaaaacaaaacaaaaaaaaaaaaaaaaaaattggtgcggcgccggccttcggagccctcgagaaaagcgtttcatataagaccattccggttgggcggcgcgggggccccaggatgggaacaggtgaacactgtgggcaaaacagcgctggtcccatagggaagatccggggggcaaggaccaagagggctggggatttccctccaccaatgtaaaaaaaggcgccgcgggggggaaacaccgagaaaggggctcccgagaacacacaattcccccaaatagggaacatacagagagaggacccaaaagaggggaactcctccatcacaaggaggggagtccccaagagagaactccgcgaaatatctaaaaattaaacggcccccggacgggggggagaaaaaaagagcgaagaacgaaacgaacaaacgaaagggacgacggagagaaacgagcaacaaaagaagaaagcaaggcaagacgacaacgaacaagaacagaaccgaccgagagaggaaacaaacaggagcagcgaaaacgaaacgacaagcaaaccaacgaaaagaaacagaccacaagagaagaaagagagaggagagaaagagagaaagcgagacgcagagagagcaaggacaggagcaggagagagggacaaaggcgcaaagagagaagcaaacaagaaagagagacgtaaaggcagagaagcagacaggaaagaagaaaagaacgagaaagacgaaagcaggagataacacaacagagaaaacgaccgagcaagaagaaagaagggagaggaaggggaggaagagagaaaaaaaaaaaaaaaaaaaaaaaaaaaaagaaaaaaagaaagaanaagaacaaananngaagnaaaaganagaaaanaaga

SEQ ID NO: 317734 - DNA, 1082 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaaaaaaaaaaaaaaaaaaaaaagaaaaaaaaaaaaagggggtttttttgggggggggaaaaggtaagagtctaaatgtcgttctcgacccacctttttttgtaccagggggaaaaatcggccgacccccaagaggaggcgacataaacaatcagcaacggcgcgtgttctcttttagtattctcgcgatcaacaatgataagcgaagacagacagagtacgtaagacagtatgagactaaaatcagagcagaactagcacacgcgtcaacgagtacaataagatagtcaagcagatattgtcacagaatgaagaatatcaagaagacaacacagacacagagtcaatgaaagagcactgtataggtaac

SEQ ID NO: 317735 - DNA, 779 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaataattattctctgttctttacctttttattcatttctcctatcttccgtttttttaattaattt

SEQ ID NO: 317736 - DNA, 1107 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggggtacctccctggtggctaattgtgtgcacaaagttaaacccttgaagggcaagggcacaacacaagcgcatatgagcgaacacagtgccagaccgcacgactagatcgtcccaaaaacacaacgaagacagctgagagaacaaaagacacaccgggatgggagagggacgacccgggacagcgacgagaaaagaagaagacgctcggcgcagaccacccacacgcagtgggggcgccgacgagagcgcccaccgcggagagcaaggcaaagacggaggggtcccgaagacaaggccgccaccgagcgaagagaacagcccacggggatgcacaaaacaggagtgcggccggggggccagtccagcaccgcagcaagacaaaagacgccaggcgcgaggacgaacccacgatgcgtgttgtcggaacacgaaaccaccac

SEQ ID NO: 317737 - DNA, 641 bp, Homo sapiens
  misc_feature (30)..(30): n is a, c, g, or t
gattcggcacgaaggcgggcgaggacattnatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317738 - DNA, 706 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317739 - DNA, 589 bp, Homo sapiens
gaattcggcacgcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317740 - DNA, 709 bp, Homo sapiens
  misc_feature (673)..(673): n is a, c, g, or t
  misc_feature (683)..(683): n is a, c, g, or t
  misc_feature (685)..(686): n is a, c, g, or t
  misc_feature (691)..(691): n is a, c, g, or t
  misc_feature (698)..(698): n is a, c, g, or t
  misc_feature (705)..(705): n is a, c, g, or t
gaattcggcacgcgcttcgggagccgcggcttatggtgcagacatggccaagtccaagaaccacaccacacacaaccagtcccgaaaatggcacagaaatggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaaaaaaaaaaaaaaaaaaaaaaaaaaaaaaaaaaaaaaaaaaaaaaaaaaagaaaaaaagaaagaanaagaacaaananngaagnaaaaganagaaaanaaga

SEQ ID NO: 317741 - DNA, 1167 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaaggggcctgaagtgtaaccctctggtcagggtgtaacctgcctcctgagggcagtttggctatctcccttgcttggcagtggcacttagggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaaaaaaaaaaaaaaaaaaaaaagaaaaaaaaaaaaagggggtttttttgggggggggaaaaggtaagagtctaaatgtcgttctcgacccacctttttttgtaccagggggaaaaatcggccgacccccaagaggaggcgacataaacaatcagcaacggcgcgtgttctcttttagtattctcgcgatcaacaatgataagcgaagacagacagagtacgtaagacagtatgagactaaaatcagagcagaactagcacacgcgtcaacgagtacaataagatagtcaagcagatattgtcacagaatgaagaatatcaagaagacaacacagacacagagtcaatgaaagagcactgtataggtaac

SEQ ID NO: 317742 - DNA, 339 bp, Homo sapiens
gcttttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtgagtgcactgaatcacatggaagtgtcttttcttggttccaggtgcacagtcaaggcctctcatgtagtttttctctagctttggcttctgcctgagcacagcctaactggcccacccaaagcctgcaattcctttttctaccctaccagacccataataaagctttccttggtctccacag

SEQ ID NO: 317743 - DNA, 841 bp, Homo sapiens
  misc_feature (771)..(771): n is a, c, g, or t
  misc_feature (791)..(791): n is a, c, g, or t
  misc_feature (797)..(797): n is a, c, g, or t
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaaaaaaaaaaaaaaaaaattttgggcgcctccgggccctgaaaaagtttttnaaacccatctttgggggcgnggggcnccaaagggtctaggaaacggggcaagaggggtgaacaagaaaac

SEQ ID NO: 317744 - DNA, 744 bp, Homo sapiens
ccgatgccatccgcgacttacgggtggcggcggggcgcgggctgcggagaggactggtgaccgaccgtgtgtctgtcgggagcaaaagctgcggggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggagcaggatttgttagcctctgtctatgatcctgggg

SEQ ID NO: 317745 - DNA, 686 bp, Homo sapiens
  misc_feature (37)..(37): n is a, c, g, or t
gaccacgcgtcgcggacgcgtgggtcgaccacgcgtncggacccacgcgtccgggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317746 - DNA, 667 bp, Homo sapiens
ccgatgccatccgcgacttacgggtggcggcggggcgcgggctgcggagaggactggtggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317747 - DNA, 777 bp, Homo sapiens
cgcaattttccacagaggaaaataatccgagtcgaaacctcaacgacaggtccgggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaatatattcttctccttaacttttaaaaaaaaagcgtttaaaccgctgactggaaacccggtgtacccactaatggcttgcct

SEQ ID NO: 317748 - DNA, 785 bp, Homo sapiens
ttgccaaggggctcagtctgtgccggccaaaggccaaggccaaggccaaggccaaggatcaaaccaaggcccaggctgcagccccagcttcagttccagctcaggctcccccagggattcagcactcaacacagtcttcagcagtcagaccactgccaagacagcaggccagcaggtacgagcgttcagagtatccgacacagaacatgacccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317749 - DNA, 792 bp, Homo sapiens
  misc_feature (695)..(695): n is a, c, g, or t
  misc_feature (697)..(697): n is a, c, g, or t
tatacggcaggtagcgaggctgggtggcgggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaacaaaacacaaaaaaaaaaaaaaaaccaananaaaatatttgcgggcgcacaaaaaggtagaaagacagcaaaagacaaaaggataagacacatattacaaagaggaaaatgcaagcacaaaaaaca

SEQ ID NO: 317750 - DNA, 955 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaacaaaaaacaaaacaaaaaaaaaaaaaaaaaaaaaggggggggcgcaaaaaaaatacaccaggggagcacaagacaaccggtaacccagaatccgtgatcaccagaggggcccccaaaaggaggctgcgcatatcacgacaccgccagcccgcgggttgcaaccgccgcggcccggggacaacgcgcacacccgggcacctgggcacaggcacccaaacacagggggggcgacacacgggcaaacgc

SEQ ID NO: 317751 - DNA, 1066 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggagcccgtcgacgatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317752 - DNA, 796 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaatatattcttctccttaacttttaaaaaaaaagcgtttaaaccgctgactggaaacccggtgtacccactaatggcttgcct

SEQ ID NO: 317753 - DNA, 984 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaaaaaaaaaaaaaaaaaaaaaaaaacaaaaaacaaaacaaaaaaaaaaaaaaaaaaaaaggggggggcgcaaaaaaaatacaccaggggagcacaagacaaccggtaacccagaatccgtgatcaccagaggggcccccaaaaggaggctgcgcatatcacgacaccgccagcccgcgggttgcaaccgccgcggcccggggacaacgcgcacacccgggcacctgggcacaggcacccaaacacagggggggcgacacacgggcaaacgc

SEQ ID NO: 317754 - DNA, 1657 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggagcccgtcgacgatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggacaccaaaacacaaaaaaaaaaaaacacacacacaccaaaaaaaaaaggggggtcgcccgccccacagacgatcagccgagaggggcgccacacagccgggcggagacgcgcacagcacgaggcgaaaaaaggggggacaaccacagcgggaggaacaggcgaaacaaacagaaaggaaacaggtgacgggcgtggtgcgatcgacagaatgtgtagttttgcggtggggccaaaaagtagatgtataatgtagttgatgaagattagtaggagacaaggagtggaataatctagtgggggaggtggtgagcgactatacaaagaggaccaaagatgattgttgtgcacggcgcatatagtaaaagtgtgcacgcatgtggagggaacacacagacgaggaccgcaaacccacaggaagcaaaaagacgaggggaacgagaccaccacccggcggcaccaagtagcacgagtccagagagcggagaacacgagaaaggggaagcaagcaacgagggaggactggagacacgcaaacgaacacaacacaacacacccacacagcagagaagcgcaggaaagcagaacacaaga

SEQ ID NO: 317755 - DNA, 901 bp, Homo sapiens
gccagtagtactttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggagcacaggaggaccccagccccatgcagatggtagcccaggggcgggggtggggggtcgcaccagtccttctgtcctcatgttggcagagatatctactctgaagcctttgtaggggcctgggtacgtttgggagcctgagctggaactgaagctggggctgcagcctgggccttggtttgatccttggcctcgtg

SEQ ID NO: 317756 - DNA, 779 bp, Homo sapiens
ttgccaaggggctcagtctgtgccggccaaaggccaaggccaaggccaaggccaaggatcaaaccaaggcccaggctgcagccccagcttcagttccagctcaggctcccccagggattcagcactcaacacagtcttcagcagtcagaccactgccaagacagcaggccagcaggtacgagcgttcagagtatccgacacagaacatgacccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317757 - DNA, 980 bp, Homo sapiens
gaattcggcacgcgcttcgggagccgcggcttatggtgcagacatggccaagtccaagaaccacaccacacacaaccagtcccgaaaatggcacagaaatggtatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggagcccgtcgacgatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 317758 - DNA, 730 bp, Homo sapiens
  misc_feature (694)..(694): n is a, c, g, or t
  misc_feature (704)..(704): n is a, c, g, or t
  misc_feature (706)..(707): n is a, c, g, or t
  misc_feature (712)..(712): n is a, c, g, or t
  misc_feature (719)..(719): n is a, c, g, or t
  misc_feature (726)..(726): n is a, c, g, or t
gaattcggcacgcgcttcgggagccgcggcttatggtgcagacatggccaagtccaagaaccacaccacacacaaccagtcccgaaaatggcacagaaatggtatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggcaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaaaaaaaaaaaaaaaaaaaaaaaaaaaaaaaaaaaaaaaaaaaaaaaaaaagaaaaaaagaaagaanaagaacaaananngaagnaaaaganagaaaanaaga

SEQ ID NO: 317759 - DNA, 2716 bp, Homo sapiens
agcctggagtgaggcgcagcggcagcggcagcagcggcaacaagtgccggaggctagcagagccaagccggagcagtccctgccgccgacaccgccgggccgcccgtccggggcgccgcgcatggagcgtgagctgcggcggtcgccgggctgagccgcgcggagcggccgggacgtggatgtggccgcgatctcccgcccttgcccccgccccgccgagctggagctgctcccggacaagatatgagaaatgagtgttggacgtcgaagaataaagttgttgggtatcctgatgatggcaaatgtcttcatttattttattatggaagtctccaaaagcagtagccaagaaaaaaatggaaaaggggaagtaataatacccaaagagaagttctggaagatatctacccctcccgaggcatactggaaccgagagcaagagaagctgaaccggcagtacaaccccatcctgagcatgctgaccaaccagacgggggaggcgggcaggctctccaatataagccatctgaactactgcgaacctgacctgagggtcacgtcggtggttacgggttttaacaacttgccggacagatttaaagactttctgctgtatttgagatgccgcaattattcactgcttatagatcagccggataagtgtgcaaagaaacctttcttgttgctggcgattaagtccctcactccacattttgccagaaggcaagcaatccgggaatcctggggccaagaaagcaacgcagggaaccaaacggtggtgcgagtcttcctgctgggccagacacccccagaggacaaccaccccgacctttcagatatgctgaaatttgagagtgagaagcaccaagacattcttatgtggaactacagagacactttcttcaacttgtctctgaaggaagtgctgtttctcaggtgggtaagtacttcctgcccagacactgagtttgttttcaagggcgatgacgatgtttttgtgaacacccatcacatcctgaattacttgaatagtttatccaagaccaaagccaaagatctcttcataggtgatgtgatccacaatgctggacctcatcgggataagaagctgaagtactacatcccagaagttgtttactctggcctctacccaccctatgcagggggaggggggttcctctactccggccacctggccctgaggctgtaccatatcactgaccaggtccatctctaccccattgatgacgtttatactggaatgtgccttcagaaactcggcctcgttccagagaaacacaaaggcttcaggacatttgatatcgaggagaaaaacaaaaataacatctgctcctatgtagatctgatgttagtacatagtagaaaacctcaagagatgattgatatttggtctcagttgcagagtgctcatttaaaatgctaaaatagatacaaactcaattttgcatagaaaggtgtattttgaatagttcccatgttgtgttctcacattagagtaatttctatattaaaccatgaaaattgcctttatgagtgatacccatttgagggcctctaaacccttcaatttggtactcacgtgaagagggaaagcggaagatggtaatttttttttatggatgatatggcaggatgattggttctgatcttaccggctagtggtcatttttaaaaaacttgtaccctcttatctgaaatcctgtttctggaatttggccattttaagtgattttgtttgccctcttctataatattcctacttcccataataatgactgatttatttgtaattcaggtatttatttttcgtgaaatggaattatgtttatttttatgggatttgggtaaattttaaattgtctagaaaactgaaatttcagttgtcagttgtggaattcagtttttcaattgtggaaatttcctgccaccccaacagtatttttgtgtgttaattaattttgcaaaatgagaatcatggtgtgacactcatctaatttatcttgttgtgatgttatggtcataataaggagaaagagggtttaatttttcttgtatttggtttcctggtggtatcatagtgtaattttagtatttgaaaatcagtgtgattccttaatggccaactgaagattgaattgccgctaacaaccatatcgtgttagtgaattttcaatatggaccaggaaggcatatgtattttgaacttgagtgaaaaggttgaagttacagacttttgcatagatggtttgtcaatttaaaattccagaatttattattgccatattttcacatgctgcttatacaagattattattgagtagtaactgcttccctgtctatgtagaagtgcctgtgtttttatttattgttcagatcaaagaccaaaacattttcttaaatatattttatgtaatattttatttgtatacagtgttgttgatgaaatatttaactagagcatgatattttaaatgttaaggtgtaacatatgttaaataaaactgttatttttgaattttaaaatttgttttttgggggtatgaactactagagtttaaaattctgccaaactattacttatatgtactattgtgtaacatactttcttgaaatatttttgtttatagaattgaaggttcttatcagatgggatactggggactataaacaatggaaataaagccactgtattttt

SEQ ID NO: 317760 - DNA, 4929 bp, Homo sapiens
agcctggagtgaggcgcagcggcagcggcagcagcggcaacaagtgccggaggctagcagagccaagccggagcagtccctgccgccgacaccgccgggccgcccgtccggggcgccgcgcatggagcgtgagctgcggcggtcgccgggctgagccgcgcggagcggccgggacgtggatgtggccgcgatctcccgcccttgcccccgccccgccgagctggagctgctcccggacaagatatgagaaatgagtgttggacgtcgaagaataaagttgttgggtatcctgatgatggcaaatgtcttcatttattttattatggaagtctccaaaagcagtagccaagaaaaaaatggaaaaggggaagtaataatacccaaagagaagttctggaagatatctacccctcccgaggcatactggaaccgagagcaagagaagctgaaccggcagtacaaccccatcctgagcatgctgaccaaccagacgggggaggcgggcaggctctccaatataagccatctgaactactgcgaacctgacctgagggtcacgtcggtggttacgggttttaacaacttgccggacagatttaaagactttctgctgtatttgagatgccgcaattattcactgcttatagatcagccggataagtgtgcaaagaaacctttcttgttgctggcgattaagtccctcactccacattttgccagaaggcaagcaatccgggaatcctggggccaagaaagcaacgcagggaaccaaacggtggtgcgagtcttcctgctgggccagacacccccagaggacaaccaccccgacctttcagatatgctgaaatttgagagtgagaagcaccaagacattcttatgtggaactacagagacactttcttcaacttgtctctgaaggaagtgctgtttctcaggtgggtaagtacttcctgcccagacactgagtttgttttcaagggcgatgacgatgtttttgtgaacacccatcacatcctgaattacttgaatagtttatccaagaccaaagccaaagatctcttcataggtgatgtgatccacaatgctggacctcatcgggataagaagctgaagtactacatcccagaagttgtttactctggcctctacccaccctatgcagggggaggggggttcctctactccggccacctggccctgaggctgtaccatatcactgaccaggtccatctctaccccattgatgacgtttatactggaatgtgccttcagaaactcggcctcgttccagagaaacacaaaggcttcaggacatttgatatcgaggagaaaaacaaaaataacatctgctcctatgtagatctgatgttagtacatagtagaaaacctcaagagatgattgatatttggtctcagttgcagagtgctcatttaaaatgctaaaatagatacaaactcaattttgcatagaaaggtgtattttgaatagttcccatgttgtgttctcacattagagtaatttctatattaaaccatgaaaattgcctttatgagtgatacccatttgagggcctctaaacccttcaatttggtactcacgtgaagagggaaagcggaagatggtaatttttttttatggatgatatggcaggatgattggttctgatcttaccggctagtggtcatttttaaaaaacttgtaccctcttatctgaaatcctgtttctggaatttggccattttaagtgattttgtttgccctcttctataatattcctacttcccataataatgactgatttatttgtaattcaggtatttataaacctattggctacaaagactttgttaaacattatccagtggttttcgtgaaatggaattatgtttatttttatgggatttgggtaaattttaaattgtctagaaaactgaaatttcagttgtcagttgtggaattcagtttttcaattgtggaaatttcctgccaccccaacagtatttttgtgtgttaattaattttgcaaaatgagaatcatggtgtgacactcatctaatttatcttgttgtgatgttatggtcataataaggagaaagagggtttaatttttcttgtatttggtttcctggtggtatcatagtgtaattttagtatttgaaaatcagtgtgattccttaatggccaactgaagattgaattgccgctaacaaccatatcgtgttagtgaattttcaatatggaccaggaaggcatatgtattttgaacttgagtgaaaaggttgaagttacagacttttgcatagatggtttgtcaatttaaaattccagaatttattattgccatattttcacatgctgcttatacaagattattattgagtagtaactgcttccctgtctatgtagaagtgcctgtgtttttatttattgttcagatcaaagaccaaaacattttcttaaatatattttatgtaatattttatttgtatacagtgttgttgatgaaatatttaactagagcatgatattttaaatgttaaggtgtaacatatgttaaataaaactgttatttttgaattttaaaatttgttttttgggggtatgaactactagagtttaaaattctgccaaactattacttatatgtactattgtgtaacatactttcttgaaatatttttgtttatagaattgaaggttcttatcagatgggatactggggactataaacaatggaaataaagccactgtatttttaattttttgtgtaatgtgtaatctataatccttttgtttcccatatttgagaacatttttccctgaaagaggccagtttcctccccagaaaccattacagtagtgttgaactatcactgtctctcagtgcgtcatccatctttgcatttaaaatccccaaagtgctttcccatttaaagtctttaaagaaaagtgagaatatttatttatgcttccattttcagtgagtataaataatttaattagggagtggtgtggcattgtaaagattgtgttatcctaagccatttctattttggagtttgtagccacaaagatgaaatatagaatcagccttgactactcaatttcctttcatagacccatgttgagaagacactactaacgtccagtgggaaacaagtagacaattgatgaagctcaaaaaacagaagggttagtgttgtaagagcaaacagtctaatcctgtttggaatgtggaagccatttctgagcaagtatgaggacacaggtgcttgatttgagattgaagactgttttcagcctggtcttcctgaaggtttcctggggcctgcatctgccttctactcccatggctgctagcacacacctcccagagggccatattgccacattatggctagagaagagtaaagaagaaaagaagctctgagaacattcacaggtaattggatcacatttgcatttgtccaaaaaacctgaccacgcattctcaggtaataggtttctcctctcagaggaatttcaattttttttcttgttagagattccccttctctgaggtttcaagtctcttgtagagaaagaagagatggagcaggttttgaatgaggtgtggagggccactggggggccttttgtgagccttcagtccacatgtgtgctgttgtttgaacatgagttcttggtgctgatgacatttggatgagatgatctctggcccttcttcatttggcagaagttcttgtgcaatggctgcccaagcccaccacactggtcattgctgccctgtgagatggacctcatgggctttttagcagagcacgttaggttttagagctttacgcatgcttgggctctgttatggcgcaaacccttaaatccaggaaggcctctcttggtgcccacaatatgggttctcacctgatcccccatctcacggatggaactgctgtaagtctaacttattctttgagaactgtttaacaattaggcctcaagggaaactggtattttgggcccttttcttggctattcccaagtcatgttgattttgagtttgaaggtcaaaaaggctgaaagcattgccagggtttggactattcaaaaacccaagcaggtcttaaaaaaaggatgcaagagacaagaatggctcattccccttcctgatcctggttatacccatgtcctttcttgagatggtcaagagaggctggaaagaagaacaggaaattgggggagtgctttgttacacttggaaattgagtcaagaattaaagacacccaaagtgggccatctcctacttgtccacacctgattggtggtgatgcggaatatttgatgtcccgggtcatcttgactttctcagatgcaaaaagggagggtgactttactaatggaaaggatgggaagctgaaatgaatgaagccttcagttgggccaaagtttaacttccccgtgatttgccttctgatgaaaaatgccagatgaagtgaaaattcttgtttcttgcctagaacaggaaaatacatactttacatgctgggctattgaggctatgaaattaggttttccttaatgtaaatccaattgctagaaacatttgccaaataagattttttgaactgaactttgtttgcattaatctgaaaaactgaagtattctgactcatgaagttctcaaagtaatacactaaaaaagttttgcccttaataccattatatcttgtagaggccaagaatgagggacttctgtctttaaagagccctaaaaatctcgtttgctcacatgatatgaattaccgtatttgttgtaaatgcgcaactttgtatacactaaaagcactgccaatatgattttttatcagttgtgcctcagttagagatattaaaatgtgacatcttaaatattacatattagaataattg

SEQ ID NO: 317761 - DNA, 2705 bp, Homo sapiens
agcctggagtgaggcgcagcggcagcggcagcagcggcaacaagtgccggaggctagcagagccaagccggagcagtccctgccgccgacaccgccgggccgcccgtccggggcgccgcgcatggagcgtgagctgcggcggtcgccgggctgagccgcgcggagcggccgggacgtggatgtggccgcgatctcccgcccttgcccccgccccgccgagctggagctgctcccggacaagatatgagaaatgagtgttggacgtcgaagaataaagttgttgggtatcctgatgatggcaaatgtcttcatttattttattatggaagtctccaaaagcagtagccaagaaaaaaatggaaaaggggaagtaataatacccaaagagaagttctggaagatatctacccctcccgaggcatactggaaccgagagcaagagaagctgaaccggcagtacaaccccatcctgagcatgctgaccaaccagacgggggaggcgggcaggctctccaatataagccatctgaactactgcgaacctgacctgagggtcacgtcggtggttacgggttttaacaacttgccggacagatttaaagactttctgctgtatttgagatgccgcaattattcactgcttatagatcagccggataagtgtgcaaagaaacctttcttgttgctggcgattaagtccctcactccacattttgccagaaggcaagcaatccgggaatcctggggccaagaaagcaacgcagggaaccaaacggtggtgcgagtcttcctgctgggccagacacccccagaggacaaccaccccgacctttcagatatgctgaaatttgagagtgagaagcaccaagacattcttatgtggaactacagagacactttcttcaacttgtctctgaaggaagtgctgtttctcaggtgggtaagtacttcctgcccagacactgagtttgttttcaagggcgatgacgatgtttttgtgaacacccatcacatcctgaattacttgaatagtttatccaagaccaaagccaaagatctcttcataggtgatgtgatccacaatgctggacctcatcgggataagaagctgaagtactacatcccagaagttgtttactctggcctctacccaccctatgcagggggaggggggttcctctactccggccacctggccctgaggctgtaccatatcactgaccaggtccatctctaccccattgatgacgtttatactggaatgtgccttcagaaactcggcctcgttccagagaaacacaaaggcttcaggacatttgatatcgaggagaaaaacaaaaataacatctgctcctatgtagatctgatgttagtacatagtagaaaacctcaagagatgattgatatttggtctcagttgcagagtgctcatttaaaatgctaaaatagatacaaactcaattttgcatagaaaggtgtattttgaatagttcccatgttgtgttctcacattagagtaatttctatattaaaccatgaaaattgcctttatgagtgatacccatttgagggcctctaaacccttcaatttggtactcacgtgaagagggaaagcggaagatggtaatttttttttatggatgatatggcaggatgattggttctgatcttaccggctagtggtcatttttaaaaaacttgtaccctcttatctgaaatcctgtttctggaatttggccattttaagtgattttgtttgccctcttctataatattcctacttcccataataatgactgatttatttgtaattcaggtatttataaacctattggctacaaagactttgttaaacattatccagtggttttcgtgaaatggaattatgtttatttttatgggatttgggtaaattttaaattgtctagaaaactgaaatttcagttgtcagttgtggaattcagtttttcaattgtggaaatttcctgccaccccaacagtatttttgtgtgttaattaattttgcaaaatgagaatcatggtgtgacactcatctaatttatcttgttgtgatgttatggtcataataaggagaaagagggtttaatttttcttgtatttggtttcctggtggtatcatagtgtaattttagtatttgaaaatcagtgtgattccttaatggccaactgaagattgaattgccgctaacaaccatatcgtgttagtgaattttcaatatggaccaggaaggcatatgtattttgaacttgagtgaaaaggttgaagttacagacttttgcatagatggtttgtcaatttaaaattccagaatttattattgccatattttcacatgctgcttatacaagattattattgagtagtaactgcttccctgtctatgtagaagtgcctgtgtttttatttattgttcagatcaaagaccaaaacattttcttaaatatattttatgtaatattttatttgtatacagtgttgttgatgaaatatttaactagagcatgatattttaaatgttaaggtgtaacatatgttaaataaaactgttatttttgaattttaaaatttgttttttgggggtatgaactactagagtttaaaatttttgtttatagaattgaaggttcttatcagatgggatactggggactataaacaatggaaataaagccactgtattttt

SEQ ID NO: 317762 - DNA, 2759 bp, Homo sapiens
agcctggagtgaggcgcagcggcagcggcagcagcggcaacaagtgccggaggctagcagagccaagccggagcagtccctgccgccgacaccgccgggccgcccgtccggggcgccgcgcatggagcgtgagctgcggcggtcgccgggctgagccgcgcggagcggccgggacgtggatgtggccgcgatctcccgcccttgcccccgccccgccgagctggagctgctcccggacaagatatgagaaatgagtgttggacgtcgaagaataaagttgttgggtatcctgatgatggcaaatgtcttcatttattttattatggaagtctccaaaagcagtagccaagaaaaaaatggaaaaggggaagtaataatacccaaagagaagttctggaagatatctacccctcccgaggcatactggaaccgagagcaagagaagctgaaccggcagtacaaccccatcctgagcatgctgaccaaccagacgggggaggcgggcaggctctccaatataagccatctgaactactgcgaacctgacctgagggtcacgtcggtggttacgggttttaacaacttgccggacagatttaaagactttctgctgtatttgagatgccgcaattattcactgcttatagatcagccggataagtgtgcaaagaaacctttcttgttgctggcgattaagtccctcactccacattttgccagaaggcaagcaatccgggaatcctggggccaagaaagcaacgcagggaaccaaacggtggtgcgagtcttcctgctgggccagacacccccagaggacaaccaccccgacctttcagatatgctgaaatttgagagtgagaagcaccaagacattcttatgtggaactacagagacactttcttcaacttgtctctgaaggaagtgctgtttctcaggtgggtaagtacttcctgcccagacactgagtttgttttcaagggcgatgacgatgtttttgtgaacacccatcacatcctgaattacttgaatagtttatccaagaccaaagccaaagatctcttcataggtgatgtgatccacaatgctggacctcatcgggataagaagctgaagtactacatcccagaagttgtttactctggcctctacccaccctatgcagggggaggggggttcctctactccggccacctggccctgaggctgtaccatatcactgaccaggtccatctctaccccattgatgacgtttatactggaatgtgccttcagaaactcggcctcgttccagagaaacacaaaggcttcaggacatttgatatcgaggagaaaaacaaaaataacatctgctcctatgtagatctgatgttagtacatagtagaaaacctcaagagatgattgatatttggtctcagttgcagagtgctcatttaaaatgctaaaatagatacaaactcaattttgcatagaaaggtgtattttgaatagttcccatgttgtgttctcacattagagtaatttctatattaaaccatgaaaattgcctttatgagtgatacccatttgagggcctctaaacccttcaatttggtactcacgtgaagagggaaagcggaagatggtaatttttttttatggatgatatggcaggatgattggttctgatcttaccggctagtggtcatttttaaaaaacttgtaccctcttatctgaaatcctgtttctggaatttggccattttaagtgattttgtttgccctcttctataatattcctacttcccataataatgactgatttatttgtaattcaggtatttataaacctattggctacaaagactttgttaaacattatccagtggttttcgtgaaatggaattatgtttatttttatgggatttgggtaaattttaaattgtctagaaaactgaaatttcagttgtcagttgtggaattcagtttttcaattgtggaaatttcctgccaccccaacagtatttttgtgtgttaattaattttgcaaaatgagaatcatggtgtgacactcatctaatttatcttgttgtgatgttatggtcataataaggagaaagagggtttaatttttcttgtatttggtttcctggtggtatcatagtgtaattttagtatttgaaaatcagtgtgattccttaatggccaactgaagattgaattgccgctaacaaccatatcgtgttagtgaattttcaatatggaccaggaaggcatatgtattttgaacttgagtgaaaaggttgaagttacagacttttgcatagatggtttgtcaatttaaaattccagaatttattattgccatattttcacatgctgcttatacaagattattattgagtagtaactgcttccctgtctatgtagaagtgcctgtgtttttatttattgttcagatcaaagaccaaaacattttcttaaatatattttatgtaatattttatttgtatacagtgttgttgatgaaatatttaactagagcatgatattttaaatgttaaggtgtaacatatgttaaataaaactgttatttttgaattttaaaatttgttttttgggggtatgaactactagagtttaaaattctgccaaactattacttatatgtactattgtgtaacatactttcttgaaatatttttgtttatagaattgaaggttcttatcagatgggatactggggactataaacaatggaaataaagccactgtattttt

SEQ ID NO: 317763 - DNA, 2496 bp, Homo sapiens
ggatccttgtgggcatgatccataatcggtttcaaggtaacgatggtgtcgaggtctttgttgggtatcctgatgatggcaaatgtcttcatttattttattatggaagtctccaaaagcagtagccaagaaaaaaatggaaaaggggaagtaataatacccaaagagaagttctggaagatatctacccctcccgaggcatactggaaccgagagcaagagaagctgaaccggcagtacaaccccatcctgagcatgctgaccaaccagacgggggaggcgggcaggctctccaatataagccatctgaactactgcgaacctgacctgagggtcacgtcggtggttacgggttttaacaacttgccggacagatttaaagactttctgctgtatttgagatgccgcaattattcactgcttatagatcagccggataagtgtgcaaagaaacctttcttgttgctggcgattaagtccctcactccacattttgccagaaggcaagcaatccgggaatcctggggccaagaaagcaacgcagggaaccaaacggtggtgcgagtcttcctgctgggccagacacccccagaggacaaccaccccgacctttcagatatgctgaaatttgagagtgagaagcaccaagacattcttatgtggaactacagagacactttcttcaacttgtctctgaaggaagtgctgtttctcaggtgggtaagtacttcctgcccagacactgagtttgttttcaagggcgatgacgatgtttttgtgaacacccatcacatcctgaattacttgaatagtttatccaagaccaaagccaaagatctcttcataggtgatgtgatccacaatgctggacctcatcgggataagaagctgaagtactacatcccagaagttgtttactctggcctctacccaccctatgcagggggaggggggttcctctactccggccacctggccctgaggctgtaccatatcactgaccaggtccatctctaccccattgatgacgtttatactggaatgtgccttcagaaactcggcctcgttccagagaaacacaaaggcttcaggacatttgatatcgaggagaaaaacaaaaataacatctgctcctatgtagatctgatgttagtacatagtagaaaacctcaagagatgattgatatttggtctcagttgcagagtgctcatttaaaatgctaaaatagatacaaactcaattttgcatagaaaggtgtattttgaatagttcccatgttgtgttctcacattagagtaatttctatattaaaccatgaaaattgcctttatgagtgatacccatttgagggcctctaaacccttcaatttggtactcacgtgaagagggaaagcggaagatggtaatttttttttatggatgatatggcaggatgattggttctgatcttaccggctagtggtcatttttaaaaaacttgtaccctcttatctgaaatcctgtttctggaatttggccattttaagtgattttgtttgccctcttctataatattcctacttcccataataatgactgatttatttgtaattcaggtatttatttttcgtgaaatggaattatgtttatttttatgggatttgggtaaattttaaattgtctagaaaactgaaatttcagttgtcagttgtggaattcagtttttcaattgtggaaatttcctgccaccccaacagtatttttgtgtgttaattaattttgcaaaatgagaatcatggtgtgacactcatctaatttatcttgttgtgatgttatggtcataataaggagaaagagggtttaatttttcttgtatttggtttcctggtggtatcatagtgtaattttagtatttgaaaatcagtgtgattccttaatggccaactgaagattgaattgccgctaacaaccatatcgtgttagtgaattttcaatatggaccaggaaggcatatgtattttgaacttgagtgaaaaggttgaagttacagacttttgcatagatggtttgtcaatttaaaattccagaatttattattgccatattttcacatgctgcttatacaagattattattgagtagtaactgcttccctgtctatgtagaagtgcctgtgtttttatttattgttcagatcaaagaccaaaacattttcttaaatatattttatgtaatattttatttgtatacagtgttgttgatgaaatatttaactagagcatgatattttaaatgttaaggtgtaacatatgttaaataaaactgttatttttgaattttaaaatttgttttttgggggtatgaactactagagtttaaaattctgccaaactattacttatatgtactattgtgtaacatactttcttgaaatatttttgtttatagaattgaaggttcttatcagatgggatactggggactataaacaatggaaataaagccactgtattttt

SEQ ID NO: 317764 - DNA, 2621 bp, Homo sapiens
cccctagagccatttagctgcaaactgtctctgtctctgtttatccgagcagaacctggaaggggctggcaaggactaggcaacagatgggacagccagagagatatgagaaatgagtgttggacgtcgaagaataaagttgttgggtatcctgatgatggcaaatgtcttcatttattttattatggaagtctccaaaagcagtagccaagaaaaaaatggaaaaggggaagtaataatacccaaagagaagttctggaagatatctacccctcccgaggcatactggaaccgagagcaagagaagctgaaccggcagtacaaccccatcctgagcatgctgaccaaccagacgggggaggcgggcaggctctccaatataagccatctgaactactgcgaacctgacctgagggtcacgtcggtggttacgggttttaacaacttgccggacagatttaaagactttctgctgtatttgagatgccgcaattattcactgcttatagatcagccggataagtgtgcaaagaaacctttcttgttgctggcgattaagtccctcactccacattttgccagaaggcaagcaatccgggaatcctggggccaagaaagcaacgcagggaaccaaacggtggtgcgagtcttcctgctgggccagacacccccagaggacaaccaccccgacctttcagatatgctgaaatttgagagtgagaagcaccaagacattcttatgtggaactacagagacactttcttcaacttgtctctgaaggaagtgctgtttctcaggtgggtaagtacttcctgcccagacactgagtttgttttcaagggcgatgacgatgtttttgtgaacacccatcacatcctgaattacttgaatagtttatccaagaccaaagccaaagatctcttcataggtgatgtgatccacaatgctggacctcatcgggataagaagctgaagtactacatcccagaagttgtttactctggcctctacccaccctatgcagggggaggggggttcctctactccggccacctggccctgaggctgtaccatatcactgaccaggtccatctctaccccattgatgacgtttatactggaatgtgccttcagaaactcggcctcgttccagagaaacacaaaggcttcaggacatttgatatcgaggagaaaaacaaaaataacatctgctcctatgtagatctgatgttagtacatagtagaaaacctcaagagatgattgatatttggtctcagttgcagagtgctcatttaaaatgctaaaatagatacaaactcaattttgcatagaaaggtgtattttgaatagttcccatgttgtgttctcacattagagtaatttctatattaaaccatgaaaattgcctttatgagtgatacccatttgagggcctctaaacccttcaatttggtactcacgtgaagagggaaagcggaagatggtaatttttttttatggatgatatggcaggatgattggttctgatcttaccggctagtggtcatttttaaaaaacttgtaccctcttatctgaaatcctgtttctggaatttggccattttaagtgattttgtttgccctcttctataatattcctacttcccataataatgactgatttatttgtaattcaggtatttataaacctattggctacaaagactttgttaaacattatccagtggttttcgtgaaatggaattatgtttatttttatgggatttgggtaaattttaaattgtctagaaaactgaaatttcagttgtcagttgtggaattcagtttttcaattgtggaaatttcctgccaccccaacagtatttttgtgtgttaattaattttgcaaaatgagaatcatggtgtgacactcatctaatttatcttgttgtgatgttatggtcataataaggagaaagagggtttaatttttcttgtatttggtttcctggtggtatcatagtgtaattttagtatttgaaaatcagtgtgattccttaatggccaactgaagattgaattgccgctaacaaccatatcgtgttagtgaattttcaatatggaccaggaaggcatatgtattttgaacttgagtgaaaaggttgaagttacagacttttgcatagatggtttgtcaatttaaaattccagaatttattattgccatattttcacatgctgcttatacaagattattattgagtagtaactgcttccctgtctatgtagaagtgcctgtgtttttatttattgttcagatcaaagaccaaaacattttcttaaatatattttatgtaatattttatttgtatacagtgttgttgatgaaatatttaactagagcatgatattttaaatgttaaggtgtaacatatgttaaataaaactgttatttttgaattttaaaatttgttttttgggggtatgaactactagagtttaaaattctgccaaactattacttatatgtactattgtgtaacatactttcttgaaatatttttgtttatagaattgaaggttcttatcagatgggatactggggactataaacaatggaaataaagccactgtattttt

SEQ ID NO: 317765 - DNA, 448 bp, Homo sapiens
tactattgcattcatgaagaaggagggagatgaaaaattaggcattctaactgggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggggtaagtctctgaagtctttttatgg

SEQ ID NO: 317766 - DNA, 6972 bp, Homo sapiens
cgcgacagtcggggccgaggcccagggggaggtggcctgtcgcgggtcgcccggctcccggaggcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317767 - DNA, 7044 bp, Homo sapiens
cgcgacagtcggggccgaggcccagggggaggtggcctgtcgcgggtcgcccggctcccggaggcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatatagaatctgcaaactgcttcagatcaaacagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317768 - DNA, 6928 bp, Homo sapiens
ggaagagagcttcagagaaacgtggaacaccattaactgctccaacatacacttagtatctgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317769 - DNA, 6914 bp, Homo sapiens
ggaagagagcttcagagaaacgtggaacaccattaactgctccaacatacacttagtatctgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317770 - DNA, 6915 bp, Homo sapiens
ggctctgagaaggaattacttctctagaatgcaaagtgggcatctgagccagagaatgaagccctggtccatatttagtcattatttagggagagtgaggagtaacaatttcaaaattagagtttggattaagcaaagaaaatactagtcacaaattggctggtgtatgagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc
